United States Patent 11,446,398 (REGULATED BIOCIRCUIT SYSTEMS) - sequence listing, part 73

SEQ ID NO: 173705 - DNA, 3519 bp, Homo sapiens
  Payload ID: 14114
  Gene Symbol: RSAD2
  Gene Name: radical S-adenosyl methionine domain containing 2
  Uniprot ID: Q8WXG1
  ENST ID: ENST00000382040
  CDS Start-End: 137-1222
aactcagctgagtgttagtcaaagaaggtgtgtcctgctccccaatgacaggttgctcagagactgctgatttccatccctatataaagagagtccctggcatacagagactgctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcgctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttgcctttatgccattgcagtcttgtactttttactgtgatgtacagaaatagtcaacagatgtttccaagaacatatgatatgataatcctaccaattttcaagaagtctctagaaagagataacacatggaaagacggtgtggtgcagcccagcccacggtggctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacggcacactgggttggcataagatatcctaaaatcacgctggaaccttgggcaaggaagaatgtgagcaagagtagagagagtgcctggatttcatgtcagtgaagccaagtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatttcagtgttcctcactaggtggcatttaaatgtcgcctgatgtcattaagcaccatccaaaaagtctgcttcataatctattttcaagacttggtgattctgaaagttttggtttttgtgactttgtttctcaggaaaaaaaatattcctacttaaattttaagtctataattcaatttaaatatgtgtgtgtctcatccaggataggataggttgtcttctattttccattttacctatttactttttttgtaagaaaagagaaaaatgaattctaaagatgttccccatgggttttgattgtgtctaagctatgatgaccttcatataatcagcataaacataaaacaaattttttacttaacatgagtgcactttactaatcctcatggcacagtggctcacgcctgtaatcccagcacttgggaggacaatgtgggtggatcacgaggtcaggagttcgagaacagcctggccaacatggtgaaaccccgtctccactaaaaatacaaaaattagccaggcatggtggcgtacacttgtaattccagctactcaagaggctgaggcaggaggattgcttgaaccctgaaggcagaggttacagagccaagatagcgccactgcactccagcctggatgacagagcaagactccgtctcaaaaaaaaaaaaaaaaaaaagcaagagagttcaactaagaaaggtcacatatgtgaaagcccaaggacactgtttgatatacagcaggtattcaatcagtgttatttgaaaccaaatctgaatttgaagtttgaatcttctgagttggaatgaatttttttctagctgagggaaactgtatttttctttccccaaagaggaatgtaatgtaaagtgaaataaaactataagctatgttaaataca

SEQ ID NO: 173706 - DNA, 499 bp, Homo sapiens
  Payload ID: 14114
  Gene Symbol: RSAD2
  Gene Name: radical S-adenosyl methionine domain containing 2
  ENST ID: ENST00000442639
  CDS Start-End: 77-499
acgaaagccggaggcccaggcggggcaggagccctggggctggggcgcccttccggcctctcctcctcgccgcgagatgtgcgcgataaacggccggcgctcgggagcagacgcttggccccggggccccaggtgcgcggctccgcgggcctgcgcggtccccaggcgccggctcccggggctgacaccgaatgaggccccgcgccgtcggccccaaggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggagg

SEQ ID NO: 173707 - DNA, 4491 bp, Homo sapiens
  Payload ID: 14115
  Gene Symbol: RDX
  Gene Name: radixin
  Uniprot ID: P35241
  ENST ID: ENST00000343115
  CDS Start-End: 321-2072
agcggcggcgttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctca

SEQ ID NO: 173708 - DNA, 2761 bp, Homo sapiens
  Payload ID: 14115
  Gene Symbol: RDX
  Gene Name: radixin
  Uniprot ID: P35241
  ENST ID: ENST00000405097
  CDS Start-End: 311-2125
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 173709 - DNA, 562 bp, Homo sapiens
  Payload ID: 14115
  Gene Symbol: RDX
  Gene Name: radixin
  ENST ID: ENST00000534683
  CDS Start-End: 328-482
attgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaa

SEQ ID NO: 173710 - DNA, 2511 bp, Homo sapiens
  Payload ID: 14115
  Gene Symbol: RDX
  Gene Name: radixin
  Uniprot ID: P35241
  ENST ID: ENST00000528498
  CDS Start-End: 311-2125
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactagggctacaaagaatgctagagtggagacaagagtccagactctgaaataacctcctttggacacagaagctaccactgttgcttatcagacgcagcgggccctgggtttttctggggccttaagcagtgaaccctggtcagctggcctgagtcccaacccaagcccatcaccacaagcctcaagacaggaagatctcagtgaaacctttcctctaatccaagtgacatcattgtcgcaggtgtttgtacatgaaagcagagtgatgaaggtgtgtgggtccacggaagaagtaaaaatacagcactagttcatatttttcctagtctctccctgttcccaggtaaagttatagcat

SEQ ID NO: 173711 - DNA, 544 bp, Homo sapiens
  Payload ID: 14115
  Gene Symbol: RDX
  Gene Name: radixin
  ENST ID: ENST00000533991
  CDS Start-End: 196-544
ttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcct

SEQ ID NO: 173712 - DNA, 1911 bp, Homo sapiens
  Payload ID: 14115
  Gene Symbol: RDX
  Gene Name: radixin
  ENST ID: ENST00000530131
  CDS Start-End: 213-371
atattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccagtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtgg

SEQ ID NO: 173713 - DNA, 1814 bp, Homo sapiens
  Payload ID: 14115
  Gene Symbol: RDX
  Gene Name: radixin
  Uniprot ID: P35241
  ENST ID: ENST00000528900
  CDS Start-End: 405-1178
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 173714 - DNA, 803 bp, Homo sapiens
  Payload ID: 14115
  Gene Symbol: RDX
  Gene Name: radixin
  ENST ID: ENST00000528556
  CDS Start-End: 196-348
gcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccatcttgctgtgttccccaggctggtctcaaactcctgacctcaagagatcctcccaccttggccttccaaagtgctgggactaaagatgtgaggcaccatgtccagctcttgctctgccttttaatatccacgtgtccttagatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcg

SEQ ID NO: 173715 - DNA, 531 bp, Homo sapiens
  Payload ID: 14115
  Gene Symbol: RDX
  Gene Name: radixin
  ENST ID: ENST00000533678
  CDS Start-End: 217-351
ggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccagctggtctcaaactcctgacctcaagagatcctcccaccttggccttccaaagtgctgggactaaagatgtgaggcaccatgtccagctcttgctctgccttttaatatccacgtgtccttagatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaag

SEQ ID NO: 173716 - DNA, 1549 bp, Homo sapiens
  Payload ID: 14115
  Gene Symbol: RDX
  Gene Name: radixin
  Uniprot ID: P35241
  ENST ID: ENST00000530301
  CDS Start-End: 311-913
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacaagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggcccctggctactgacttatgggaagctttaggataaggacatacctggtgttctgaatgtgtatatcccccaaagtctgcaatctcagctggaactggatggaccagtattccattacccagggccctggctcatggttctctcctcttctcagtttactgttggatttccctttcttgctattctctttctctccagacccctctcaattgcctttcctaaagacagaccttagcaagatgggccaggacttgggacttcgcacagcaccctgcagtcccaagccagcatctactgcaccccatcttcaggactctatcccccaaacatgctggaaggcatcagcttatgagaacccacttttttctgcatgactagcttgtaaggaagaatctatggacaggatttccaagaatttcccactttttcaaaaaatgtatgtgacttatatttggcttcaatccaagagcaaactcagtggtgaacagctccatttctgtgcacatgttggtggaatctgcagaaatcgatgcaacatttctttcctgtctgggctgtttgtataattgtatataaatgtagcaataaatatattctaacatca

SEQ ID NO: 173717 - DNA, 536 bp, Homo sapiens
  Payload ID: 14115
  Gene Symbol: RDX
  Gene Name: radixin
  ENST ID: ENST00000532118
  CDS Start-End: 92-536
cttttagtatttaataattgcaaatgatagtgtattattttgttttctgctcaccttaggaacaatacagatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaac

SEQ ID NO: 173718 - DNA, 2558 bp, Homo sapiens
  Payload ID: 14115
  Gene Symbol: RDX
  Gene Name: radixin
  Uniprot ID: P35241
  ENST ID: ENST00000530749
  CDS Start-End: 311-2125
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtggggacccaaactgtatgcattgttccagatgcgctcttgccaaagcagcataaagcaaatgtaacccttaggaagaaggctccctccctcactaggccactgctgcaggacagtgaagctgacttaaaatgcccctgccctgggctacaaagaatgctagagtggagacaagagtccagactctgaaataacctcctttggacacagaagctaccactgttgcttatcagacgcagcgggccctgggtttttctggggccttaagcagtgaaccctggtcagctggcctgagtcccaacccaagcccatcaccacaagcctcaagacaggaagatctcagtgaaacctttcctctaatccaagtgacatcattgtcgcaggtgtttgtacatgaaagcagagtgatgaaggtgtgtgggtccacggaagaagtaaaaatacagcactagttcatatttttcctagtctctccctgttcccaggtaaagttatagcat

SEQ ID NO: 173719 - DNA, 4117 bp, Homo sapiens
  Payload ID: 14115
  Gene Symbol: RDX
  Gene Name: radixin
  Uniprot ID: P35241
  ENST ID: ENST00000544551
  CDS Start-End: 348-1691
ttggcgctcagtccgcggcgcgaggacggccggccggcagggggaggcgggggggcgccgggcagccccgccttttcccgcggaggcgccgagcggccatattgcggagctgtctgcggtggcggcggcgcctctcgtctcccgcgggccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaaatgccgaaaccaatcaacgtaagagtaactacaatggatgctgagctggaatttgccattcagcccaatacaactggcaaacaactttttgaccagtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgccttc

SEQ ID NO: 173720 - DNA, 3300 bp, Homo sapiens
  Payload ID: 14116
  Gene Symbol: RAF1
  Gene Name: Raf-1 proto-oncogene, serine/threonine kinase
  Uniprot ID: P04049
  ENST ID: ENST00000251849
  CDS Start-End: 441-2387
agtcgactgccagtagggctcgcgcagaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaa

SEQ ID NO: 173721 - DNA, 962 bp, Homo sapiens
  Payload ID: 14116
  Gene Symbol: RAF1
  Gene Name: Raf-1 proto-oncogene, serine/threonine kinase
  ENST ID: ENST00000416093
  CDS Start-End: 340-549
agagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagg

SEQ ID NO: 173722 - DNA, 1831 bp, Homo sapiens
  Payload ID: 14116
  Gene Symbol: RAF1
  Gene Name: Raf-1 proto-oncogene, serine/threonine kinase
  ENST ID: ENST00000432427
  CDS Start-End: 1-1584
aggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaagg

SEQ ID NO: 173723 - DNA, 2354 bp, Homo sapiens
  Payload ID: 14116
  Gene Symbol: RAF1
  Gene Name: Raf-1 proto-oncogene, serine/threonine kinase
  ENST ID: ENST00000423275
  CDS Start-End: 340-549
agagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtgtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccct

SEQ ID NO: 173724 - DNA, 3085 bp, Homo sapiens
  Payload ID: 14116
  Gene Symbol: RAF1
  Gene Name: Raf-1 proto-oncogene, serine/threonine kinase
  Uniprot ID: P04049
  ENST ID: ENST00000442415
  CDS Start-End: 363-2369
ggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgagaataacaacctgagtgcttctcccagggcgtggtccagacgattttgtttgaggggaagagatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccag

SEQ ID NO: 173725 - DNA, 5827 bp, Homo sapiens
  Payload ID: 14117
  Gene Symbol: RFTN2
  Gene Name: raftlin family member 2
  Uniprot ID: Q52LD8
  ENST ID: ENST00000295049
  CDS Start-End: 538-2043
gagggaaaacagaaaaagaattgtgtgccactatgtctgaatatatcttctacttgtagataattacatccaagttgcccttttgcctttttatttccgtttttggacacctctttttatcatccagccaactggaatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggttttttttgggttttttttttttttttggtttttgcttttttttttttttttggttatctatagtttagctgaaaacaaaatcaaagcagttaagtctgtaactttctttttgcagcttaaacaacagaatttgctgctctccctcccctttcctgcaatttaattccttacagattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtggacaaagacgcccaaggctcgtgattgaggaatgtcccctaacttctgaggcacaaacaaatgacgcagcaaaagaactgatagaaaagattaatgtcgctgctaaaagaggaatgaaatttgttggattcatatcacagcattattctccatctaaattctgcaatggaaccaaccatgatggagatatagaatcgatgctacatgtgagacacggttcagatgaaaactgtagaagttggaatgaagggacgttaagtgggcagtcatctgaaagcggaattgaggaagaacttcatcatgaaagtggacagtatcaaatggaacaaaatggcagccctacttcctctaaatcaagaaagggagaagcctcagataacaaattgtatacagtcttcaatgcttttgatgatgattcaacctcctgggcctatcaggaaggcatcctgtcaatgaaagtaacaagaaaaggatcagtcattagtacacttgatgctgattggctggagttaactaccttttattataaacaaggcttgtctttaattgattcttttgtattctgggaaacatctaaaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagataagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagccatgaggtgaagcaaaggaaggccctgtaaataattgttaaaatcattgccaactgaccttattgtattactttctctgcatttatgtaatatttttgaatttttccagacccagcctttcctctaatctatgtaaactttggcacaacctcccagacaaggaagaataaccaacatatttatacatttagaatcatgtttacacttctctcaactaaaacatctggttaaacagatgttccattcggttattacacaataatctatttcagcttctcatgaatgtacaaagtagactttcttacaattcctggtaaggagactgaatatctcaatcagtattttacccaattagagagagttctcaggaagttacagtcttatttaagctgaaaaataacctctctctctctttttttttctctctctctcatacacacacacagctaattagtgcaaataaatatctatttcccaaatataataattaatccacattttgtctttaactatagcatgtatatacaaagcaagcccctatgtgttaaaatattttttgaaaaaaatcttttttatgtatctttgcttttaaagggtcatgtcaccaaccctgtactgattcattgtacataaatgttgttgctcctaaaagcctaaaaatgcagacagcaaagcagcatctcttaaaattcaatatgaaaagaacccataatctcaatacataaataccttagtagagagtaagatttaatttttttttattttaaagtccaaatactatgaagaggaaaaatatcaacttcaatttgaaactgaagtcttttacatctgtctagatttgaattctgcttttattttgacttgttaaatcctgaagaatgttgaaacctagaattttcaatctggcaggagtagaaagatgctcatagcacacgcgatatgtatgataacatattttgtttcatcttgcttttctttccccttctaatagaggtggctttgccttgacccagcctttaacaatctttaaaattctacaaaataaaggattttcatttatctatgaaaggcttactttgaaagatggaacctccaagtgaattacaacttattctatcattgatgaattcagcctattatatatttttattaacattgatgttgacattgtaagatcattttaataataaaacatcatttttattgtgttattgttttattgaacacaaatattcatataatatgtttggtttgggggttttttgtggctttttttgagacggagtctcactctgtcacccaggctggaatgcagtggcacagtcgcagctcactgcaacctccacctcctggcttcaagcgattctcctgcctcagcctccagattagctggaactacagccagtgtgcgccaccacgcccagctaatttttgtatttttagtagagatggggtttcaccatgttggccaggatggtctcgatctcttgacctcatgatctgcctgccttgtcctcccaaaatgctgggattacaggcgtgagccaccatgcctggccttcatataatatgttttatacatataacagatatgtattacatgttatcaattatatagtgtatctaaactaagtcaatctccattaattgctgataaaattaacaggaattattccacttttatcatccagaagtacagtataaaggaatttaagaatattcttctcagtcttattctatagcaatagctgtcaacaatatttgcagaaatggtttttgttttgacttttagatggacttgagttccataatcaagagttagtggatttttggtagaaacaatcactgcttcaggagtccataaaacgtaatgaagttaggaagcacaaagaacaaatcagaaagatctgtttttcccaattccagggtctacaagaggtagagacttctttatcattcagcccacatacataggggattggaagtagtaaattaaaaacagagataggaatttatatttgactaagaaaaaactcagaaatatagcaataactttttttttttttttttttttttgagacagagcctcactctgtcacccaggctgcaatctcggcttactgcaacctccgcctcccaggttcaagtgactctcctgcctcagcctcctgagtagcagggattacaggcctgcaccaccatgcctggctaagttttgtaattttagtagagatggggtttcaccatgttggccaggctggtctcgaactcctggcctcaagcaatccacccaccttggcctcccaatgtgctgggattacaggtgtgagccactgcacccagccaagcaatcgcttttttaaaaaatttgtgtaagcatactttctcagtttatttttttctcccctcccgtttatttttaatctgagttatttcttattaaaataacttttattaaaataaacttactagtctgtcatatcctcaaaacttgttttagaagcatttgctccaacaattacccttaagttatgtgatgaatttgtatgatagcgaataatttatgatcaagtggttctagagtattttaaatgtgtgtaaatagctatgagcctattattttaaaaaaagaaaaaaacttgggctctctatgcctaaggagttaaatatgtctaattttattatctgccagttgtatattcagttctttttataacactatgatttccttaggggctctggcatgtgaatttttaaaacctgtaagttataatgaaaggtatcaagatcccagatgttgggtgaagatctgccattccccttggtgtagtatctatggcattttcatcttcgttttcaataccaagtgttaattccatcccctttggattgtataccaccttgttatcttttatggacacatttaacacctacctaatcaccagggaaatcagctctatcagtgtcattacaattcatttcagtaaaagagaaaaggaaaggtcaccctctttgagagattctagggctttcaggaggaggagaagcaggagacagagctacagtctattcaaatcacaactatctccaaatcatttgtgttatcaggagcaggtgtttatatatttgaatataaatgtaacagatgcattttcatttctttcattctggagtgccagaggagctgtcccgttttcccgcccttgcctgttattgattcctcaccaccattccttcttggctggaaggactgtggccctttccctccccatatggctaaagaggatttctttctcttaactcttcagagccccagagtagtactgtatggaaagtgtaaattcagatggagaatcaaatgaagtgaaattgctaacaatggggatagtatataactaagaacacattatataaaaatgtactagtggatacatagaaaaactagctaaatgttactcatcagaacttgtaacatatcaatttaaataacatttgctggtaatctatcatcccttgagaatgaattttatttgtgtaatagtgcaaagtttgcagaaccaggtctgtcagatatttaagttctgagatggtgtttgaggcagaaaattaggcaaaactgtaaaatgatgagcctcagttttgatgaggttcataaagttttggtgaagacgactgcaaaagaaatgggttctaaacatgttttgagcattcaaatttttgtatgtaaaaataccaagtaattaaatcaatggaataaatgaatcatttatgtgtaagataaa

SEQ ID NO: 173726 - DNA, 584 bp, Homo sapiens
  Payload ID: 14117
  Gene Symbol: RFTN2
  Gene Name: raftlin family member 2
  ENST ID: ENST00000454447
  CDS Start-End: 1-582
ggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacagtgaagggaatttggctacaaagcagatcgtattccttcagaggccagttatgtggaattcagctgctcaaacaccagatatgtgggtaagacagtgtgaaaagaataagaagaaagccagccgccacataaaaggtgaagacaagaataaagccactagtagaagcatcggattagacacaacctcgtcacaacctgcagagagcagacacctgcctgaggagtgccgcctttctccctcccgggaatgctggacaaaggagggaaggctggcacagcacaacagcttctctgggttcagcagcagtgacaacgtcctccgggaattagacgacggacagtttgatcaggaagatggagtgactcaggtcacttgtatgtgagc

SEQ ID NO: 173727 - DNA, 584 bp, Homo sapiens
  Payload ID: 14117
  Gene Symbol: RFTN2
  Gene Name: raftlin family member 2
  ENST ID: ENST00000429081
  CDS Start-End: 236-584
tttcttggtagtagttgagaggaaggagggtaggcgcaggacagagaggagagggaaaacagaaaaagaattgtgtgccactatgtctgaatatatcttctacttgtagataattacatccaagttgcccttttgcctttttatttccgtttttggacacctctttttatcatccagccaactggaatagacaaagcaccgctggtgccctgagcgacagaactctgattttgccatggggtgcggacttagaaagctagaagaccctgatgatagcagccctggaaaaatattttctaccctgaagagaccgcaagtggaaacaaagacagaatttgcttacgaatatgtattgctggattttactctacaagcttcatcaaacccagaagtcatcaagataaattcaattctggatatagtaacaaaagtggaaaactattatcttaaaggatatattgtcggggctattcatcctgttatacaacctgtggggcagcgaaaacacctacctgcaagttacctatacagagtggtgctattgcgcttgaaattaagcccaaagaattcggcagcacccagtg

SEQ ID NO: 173728 - DNA, 2982 bp, Homo sapiens
  Payload ID: 14118
  Gene Symbol: RFTN1
  Gene Name: raftlin, lipid raft linker 1
  Uniprot ID: Q14699
  ENST ID: ENST00000334133
  CDS Start-End: 274-2010
cgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtta

SEQ ID NO: 173729 - DNA, 599 bp, Homo sapiens
  Payload ID: 14118
  Gene Symbol: RFTN1
  Gene Name: raftlin, lipid raft linker 1
  ENST ID: ENST00000441460
  CDS Start-End: 151-599
gggtttgctctggggacagaggtgctggacgtgtaggagcagacatgccgcgcgctccgaggaagcgccggaaccaccagaagcacagggacgcgggtgccgagagtccccagcactgaaaacggggatctcctcttctcagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 173730 - DNA, 555 bp, Homo sapiens
  Payload ID: 14118
  Gene Symbol: RFTN1
  Gene Name: raftlin, lipid raft linker 1
  ENST ID: ENST00000431547
  CDS Start-End: 213-555
aaatcttgaaggatccttgtctcccaggcgctcttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaa

SEQ ID NO: 173731 - DNA, 2695 bp, Homo sapiens
  Payload ID: 14118
  Gene Symbol: RFTN1
  Gene Name: raftlin, lipid raft linker 1
  ENST ID: ENST00000432519
  CDS Start-End: 84-1712
ctcgtacagtccttcatcttcatggcagaaaggctgttctgcccctgcgccctccctggcctctctggggatccctgcagctgatgtattgtgatggagcagtggacttggatgctgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagtgcaccgtga

SEQ ID NO: 173732 - DNA, 1137 bp, Homo sapiens
  Payload ID: 14118
  Gene Symbol: RFTN1
  Gene Name: raftlin, lipid raft linker 1
  ENST ID: ENST00000451036
  CDS Start-End: 313-1137
atggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcaggg

SEQ ID NO: 173733 - DNA, 578 bp, Homo sapiens
  Payload ID: 14118
  Gene Symbol: RFTN1
  Gene Name: raftlin, lipid raft linker 1
  ENST ID: ENST00000449415
  CDS Start-End: 130-578
gaggtgctggacgtgtaggagcagacatgccgcgcgctccgaggaagcgccggaaccaccagaagcacagggacgcgggtgccgagagtccccagcactgaaaacggggatctcctcttctctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccagga

SEQ ID NO: 173734 - DNA, 577 bp, Homo sapiens
  Payload ID: 14118
  Gene Symbol: RFTN1
  Gene Name: raftlin, lipid raft linker 1
  ENST ID: ENST00000453536
  CDS Start-End: 90-443
ggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacaggaaatcacatctctgccagtagtacccttttattctcactcctttcagaaaattcctttggaatggtgaaatacagcctctcaaatctccagtgctctgtatctcagaaaactgatcttcacaatgaaggctacatcttggaattagattgctgtt

SEQ ID NO: 173735 - DNA, 616 bp, Homo sapiens
  Payload ID: 14118
  Gene Symbol: RFTN1
  Gene Name: raftlin, lipid raft linker 1
  ENST ID: ENST00000607320
  CDS Start-End: 1-267
gtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaagttacttacggcaataaatcatctatgagttagtgcaccgtgaggattgagtgtttatcgtgtcactaggaacagtcctggcctcatgtccaaaggattccagcccacaccccccattcactataagtttctaactcctggcagcatgatgacgtggtggaggaagacaaagttcccatggaaagctgcagagccagctaggcttgctgtgctttctcgtcatttgtagaaagagatggcaagtggaactcagatgccaccagtttcttcacagctctgagcatcaatcgcctcaagtgtgaaatggggtgaaatggcacccacctctttggatttttgtgaggattaataagatgtgaataaagtgcttggtccatggtaa

SEQ ID NO: 173736 - DNA, 6336 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000259351
  CDS Start-End: 268-1941
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaatatgatgtgtcagttgagtgtagttgagagtaaaagtgcgacattcccatcggagaaagcaaggcacctactggacgacagtgtcctagagtcccgcagcccccgaaggggcctggctctgacctcctcctctgctgtcaccaatggactctccctaggcagtagtgagagctcagagtttagtgaagagatgtcttcagggctggaaagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatg

SEQ ID NO: 173737 - DNA, 770 bp, Homo sapiens
  Payload ID: 14119
  Gene Symbol: RALGPS1
  Gene Name: Ral GEF with PH domain and SH3 binding motif 1
  ENST ID: ENST00000319107
  CDS Start-End: 252-770
gctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatcta

SEQ ID NO: 173738 - DNA, 2466 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000373434
  CDS Start-End: 66-1655
gacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacacgtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaatattcaacagcagaggatgatttaagtgaatcacagtacatccgtgtgatggaatgccaggagggtgtaagaaagagtgtgacagaaatgcatctattcacaaggaaacatcgcagtgactagagtgattttctgttctgtggaactgcatgtcctaaacttgtttttattaacactgaatacacttaaaccttatctataacatatgtataggtataaacaacagcaataaaacaccttattgccaccatgagcctaacagcagagccaccagggccttggaatgctgtccctcaccatggcctcttcctaattcggtttctctccctcccacctgtgccccagcaccactctcctgatttgtttgctgattattcctttagaattgcaggtcacgtacttgattccttcatgtgttgtctggggtgcatttttaaactttcttataaatagaaccataaagatgca

SEQ ID NO: 173739 - DNA, 1667 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000373436
  CDS Start-End: 228-1145
gctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcagccatgtgagaccagaaaccagcaagccagccaacctccagcatcagagccctggcaggggacagaatggaccccagatggttcacatgaagagactttaatgaacagaaccaataaagcatggcgaggcacccatgggccggcccagggtcctggggagggtggagccctaggctaaagggcatggggaagaagtgttaccaatcccagggatggctgagttctggaggatgattggctgtgcagggtctgtgggcagggagggggaagcaggagcgagcagagaaaaatccctggcctccctttcctccagccctcagtctgccaccagagcctttcattggccaaatccaatagaaagctgggggcaaggggtccaggagatgcatctcaggggtcagcctcccccgaacagaagtggcaagtgggcagggcaaaaaatgcagctgaattgtgtgaacagactactcagcatactgccaagcctcagtgtctctatctgtaaagtgggcataaaatcttcctccttca

SEQ ID NO: 173740 - DNA, 819 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000394011
  CDS Start-End: 273-599
ctgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggagaaaggctggcctgccagaatggaagactccctgcagaagtccacagtttcctccaggccacatgacacgttgcagttcaggaaaacactgcctgtgggtccaggaacctgaccctctggccttttgtctggatgccgtttgcctgctctgaagaagcgggcgttccagaaagccgaggtcaatgttggacgtcggacaaaccctgtgtgtctttgctgctccttggaatcagtgtttggccctcggagagggaagaatgtggccagcaggcagtcatttgtaaagtggagattggtttccctgacatcattaaaacccctctctcaggtca

SEQ ID NO: 173741 - DNA, 1672 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000394022
  CDS Start-End: 293-1447
cctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcagtctcccatctcagcagcctgtcacatcaaggtcaagcagaagaggcaagactcaaacccacctctggccaacaccctgcctggatgtggcccagctcctcacgagtaccagcggctcccccagcatctgctgctccgcgctccccgtggcctaggaatctaagaaatgatcaaggtcaaccaggtgcagtggctctcacctgtaatcccagcactttgggaagccgaagcaggaggatcacttgagcccaggagttcaagaccagcctgggcaacatggcaaaaccccatctctacaaaagtatataaatgatctgggcatggtggtgcgtgcctacagccccagctcctcagggcttaggcgagatcgcttgatcccaggagggggaggctacagtgagccgtgatcgcgccaccgcgctccagcttgggtgacagagcaagaccttgtctcaggaaaaaaaaaaaaaa

SEQ ID NO: 173742 - DNA, 4858 bp, Homo sapiens
  Payload ID: 14119
  Gene Symbol: RALGPS1
  Gene Name: Ral GEF with PH domain and SH3 binding motif 1
  ENST ID: ENST00000438723
  CDS Start-End: 1-461
ggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggtacctgcaaaccttatgtcatttgagtaagtctctgcaggacgtggcatgacttcagaggcttctgggaacccaggctgggcctggtggtgaagagcagtcctgggcacaggctgtgagccagggtgctgggaaactcacagctggactcaggggacacggcctgtggcctcaccatcccagagggcttcaccagtgtgggatccacctgtcagtccccagcgactctcatgacactcattctgcagcaccgcctcttggggcagtggtcagaccccacacgccctctctgggcccaccacctgcatctgcgactagagagcacccggcccacgttgggttctcagtgctttctactgcacagagtggacagcgctaactaacctgtgagaggggcccgagagaaggaacagctgtggaacaggctttttacaccccaagtgcatggggttgctcgcccacagggctgcctcagattttgtacaaccccgaagcgtcctctgcgtgtgcgtgctgtacgtgtgtgtgtgtgtgtgagcgagtgtgaactcttcaagaaacatgcattttggcacaagactcgtgacatcacacacttcattcgctttgaggccctgctttaaccttaagttatagccctgtccaccgaggaaggtcagggtgagagcctagattcctcctgtgtcaagggtccctcgcattcttttactgtaaacaaacaatgccttaaattgtgtcttgttttctgttcctatgggtgctattcatctggaaggcctgcttccaggcctctttgctgtcagcccttctgagacaggacctggcttcaggactgtggactgggctgctggcctgcttgcttcctcccttccccattcctagcagggcctgaggccctcctcttctcgcccttcccaccatgccagaatgggaagttgtgacgttgcagctccaaccgacgtgctcatagtgatcagctgtgcaggagccatgaggcaccaacctctccccgcagggcaaagcctgtgcccccatcatctcactcctttgcctgcactgccagggtggggcccaccaagattcctgatcatgacgggaagctgagtgaccctgaggccttaagcttccccagtcttggccccaaatgcagtcaccagcaagttttccattttccaagtccaagggcacaattgttgatgaccgtgtgacaatagagcgaagccccggggagtgaacggtccaacctctgcattcagttaggagctcttcacatgaatcacatccttatctgtcaccttgtgtcacattttaaagtgacttttattttgcacaaataatttttattcagaataataaatcactctttatcatagtatcttctcttccctcttcccctttagtttggatagcctaactctgagaagttaacccttaaacagttttctggaagagactgaatttctgggtccttgcagctgtgatggtttcagagctcagactgatcaggcatcaagctaccctcaagagtttctgggctggatgtttcagaacaacatctacaccagtaaagtgtaataggtcagtttcaaaacgaccaaaagacccaccactgtattttgaccaaataatgacaacttctttagaaatttgaatggcttggtgaggaaagtagttgtcaccagggcctcattttgtagttgagccttacaatgcttagtagttcatcttctttttgagcaaagactagaatactttcctcctaagagaaactcccaggtgataaaagttgatgccatcaaaccttgacaccgggtgctctgcacacccacgcggatgttgcacctcattctcccgatgactattcaaatcagcatctagaggctgaatgacaatgccaaacactccacctctgatcagaaccatgcagtgttaacactttaacctacattgaatctgattctacctgttaacttttaaaaagtcgtaagtttggatgaaagtgcaagatgtggaacatcaactacctattttccttgggtttttccactctgcaaactgtcctggtttttcacaccaatgaagtattatagatgccaatccaaaacctcagaatttcaggcaccacaaaaacaggtaattttctatcccttataagtttgtcttttctttcagaaacatctcttagcctaatttgaaatagcacaatcacaattcaaaatgtttagtcttctcactaattgagtctgcttccacgtcctctcccaggaacattcttagctcggactcttgaagaatctctttagattttgttggcaaaagccttatagaagcagtaagaggcttgaccacgccggaagagtcctggagctaaagctggaagacactcagctctctaagcaggggctcggccaaacatgggagttaagtgctgcttgtcttcccagtgttggtttgaaccctgtgagcctgagacagagagggccaggcaccaaccacaaggcgggaaagtccatgggtagaccctccccctggagggaagcatttctagtttttgctccttgactgtccagagtgtacaaatgttcataacgccattgaagggattatttcttgcatgcatatgctgaatttttttaagcaaatggatcatggcaccccaaaatgaaagttatagaaagctgtctacaactgtggagttggtagctggtaacattgttgtctcaagaacaactcacctctctccctaggactaatttttgtctctctcagttgaacatgttttgtcattcaagatcagtcaggtgcattctggcaactgacatacttgatggaggattgattcggtagagagcagtagaaatcttgttctaactgtgcctggtgagagactttggccccctccctccctataaggctgtggaacctgaggaagtagatacttgaagagattctgtttaggaagaaactcactctcttttgccagttgaatttatagagcattttttttcttaccaagatggccagtatcattttacccccacctcccaagccccaagaggtgtaccttttcagatgccattttacaggcggaaatgctccatgaaacaggaagccacttgcaagcaacatctgctctgttcctcaggtggggcccagagcccttccccgagactgctgatgtctgtaaccactggggagcactgccaaaaatacagctttctggtttgtgagcccataaatgacttaaatcagctttacatcatttttacatatcaagtggtttcatgttaaaaaacaaactcctagtcctttagaaataacagattctctgcacaaaaccacccattcattcatttattcattcacagcactagcaagtgctgcctatgctgagaacaagtcagatctgatccctgccctcatggacctgaccactcaacaaacagtccccaccacacctatctccttaggcaagactttgcctctctcctagtcctgagtataaatcctgtgcatagattcctctagaaaggcatcaaaaggctcaacagactgaatggcctcttggtctgcgaaaattcagttgcaatgaggatgaagtcactatcctagaggctgcttggcccagaagagccaggcacagagctgcagttgggcacgccaaggattccaaaggtggaatgagagagtagggtcaaactgtcacagtatctgctccataggtttctgtttttaatttcaatgttaaatacaactacaatatgagcgagaactgcattttcttgggtgttgagaacttgtaccatggacttcagaccgccttgcagccgtatgctgcacaagcgtgtacaccccctgggcagcctcaaaaccccgcttacagcagcaacacaggagatcatctgtccattttagaaccattaatctctttatccattgctgaacgactgtgactattcagtaacgaagtaatagtaattaattagtatggtataatctttaataaatttcgtgccaaaatgcatggttttccacttagcattcaaaatgttgcatagagagtagttttcaatttcttatgtactcttcgaagtaagttgaaaatcagtttctacattttaattcgtttcctgttaaatctgttgcactctcctgggctgtctttttctccagcagacccctgcatgcagttgtgtaaggactttctctaattcttgtgaatcgtctcacccgcagtaaccactgaacgtcaatcagccctccatggggttctttcgatttttggtgaagtattttgttacctcagtcttgtatcaagttgctgtatttttcagcttgttacattgataataattatttcactaattaaatactttaatgtacaaacatctttgtttactttgaaattaaatgtgttttccaatgaa

SEQ ID NO: 173743 - DNA, 2362 bp, Homo sapiens
  Payload ID: 14119
  Gene Symbol: RALGPS1
  Gene Name: Ral GEF with PH domain and SH3 binding motif 1
  Uniprot ID: Q5JS13
  ENST ID: ENST00000424082
  CDS Start-End: 305-1918
cgccgctcaggccctggagcggacggttcctactgcggctgggcaccggctccgctcccgcgtctgcccgcgctccagctgcgcctggcccggccccggcccggctcggcgtggccccggcctccaagcgaaggcgccgctgccgctgggccgctcccagggccatgaggaagcggcggcagccactgcggcccgcgtcaaggtgaccggccgggactgcggcggcggggagagcggcggacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcaagagctatgatgccgttgtcttcgatgtcttgaaagtgaccccagaggagtttgctagccagattacattaatggatatacctgtgtttaaagctatccagccggaggaactagccagctgtggatggagtaagaaggagaaacacagtcttgcccctaacgttgtggcctttacccggaggtttaaccaggtcagtttttgggttgtacgagaaattctaacagcacagactttaaaaataagggcagaaatcctcagccattttgtgaaaatagccaagaaacttctagaactcaacaaccttcattctctcatgtctgtggtatcagcattacaaagtgctcccatcttcaggctgacaaaaacctgggctcttttaaatcgaaaagacaagactacctttgagaaattggactacctgatgtcgaaagaagataattacaagcggacacgggaatatatccgaagcctgaagatggttccaagtattccctatctaggaatctatcttctggatttaatctacattgattctgcatatcctgcctcaggcagtatcatggaaaatgaacaaagatccaatcagatgaacaatattcttcgaataattgctgatttacaagtttcctgcagctatgatcacctcaccaccctgccccatgtgcagaagtacctgaagtccgtacgctacattgaagagctccagaagtttgtggaagacgacaactacaaactgtcgctcagaatcgaaccaggaagcagctctccaagactagtctcttccaaggaagatcttgcaggtccctctgctggctccggttctgcgaggttcagccggaggcccacctgtcctgacacatctgttgctggcagcctccccacacctccagtccccagacacaggaagagccacagcctaggcaacaacaggggacgtctctatgccaccctggggcccaactggcgggttccagttaggaattctcccagaacccggagctgtgtctacagccccaccggcccgtgcatctgttctctggggaactccgcagctgtgcccaccatggaggggcctctgagaagaaaaaccctgctcaaggaagggcggaagcctgcgctgtcctcgtggaccaggtactgggtcatactctcaggatccaccctcctgtactacggagccaagtccttgcggggcacagacagaaaacactataaatccacacctggcaaaaaggtttccatcgtgggctggatggtgcagctgcccgatgaccccgagcacccagatatcttccagctgaacaaccctgacaaaggcaatgtttacaagtttcagactggttcccgatttcatgcaatactgtggcacaagcatttggatgatgcatgtaaaagcaacaggcctcaggaagccggagcagctccaggtccaacaggaactgacagccacgaggtggaccacctggagggcggtgcggggaaggaggcagggccctgtgcctgaagcctgggcaccatggtggccccagtcaggagcaacagtggtagccctgagtaaaacccattgtccctctttggaggagcggccagaggatgacagcagccccagcaggcagcagtgcctgggcaggctgatccagcagagcactaatgggtcagtttcatgtattggcagatgtggtgtagcatggcaaggctacaagttttaaggatttttgtctgattttcagacctggaggaggggatttttcttcctactttcccccttttttatttctaatttactttcaaccaaatattcccactatgtgctatatgtaataataaaaagttgacaacaactgaaatattcaacagcagaggatgatttaagtgaatcacagtacatccgtgtgatggaatgccaggagggtgtaagaaagagtgtgacagaaatgcatctattcac

SEQ ID NO: 173744 - DNA, 906 bp, Homo sapiens
  Payload ID: 14120
  Gene Symbol: RALGPS2
  Gene Name: Ral GEF with PH domain and SH3 binding motif 2
  ENST ID: ENST00000324778
  CDS Start-End: 108-906
gaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtag

SEQ ID NO: 173745 - DNA, 438 bp, Homo sapiens
  Payload ID: 14120
  Gene Symbol: RALGPS2
  Gene Name: Ral GEF with PH domain and SH3 binding motif 2
  ENST ID: ENST00000367632
  CDS Start-End: 1-438
gccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatga

SEQ ID NO: 173746 - DNA, 7512 bp, Homo sapiens
  Payload ID: 14120
  Gene Symbol: RALGPS2
  Gene Name: Ral GEF with PH domain and SH3 binding motif 2
  Uniprot ID: Q86X27
  ENST ID: ENST00000367634
  CDS Start-End: 357-2030
gcgcgcgcgcgcggctccgccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaagtggtattctgttttttctaagctttgagatacaaatattgctatttaatcacattgatgatgaattactttccatgtgaaccttctcaaaatgatttaagtacctttgattttgctcccctaaaaatggcttgtgtctaaagtgacatttttttccctatttggagggttctaatgaaagagatccaggcataaaaactcttttgcttattgaaagcaatttgattacacctatgtttcaggttatagtggggagaaaatttggtcagtgccttattatttgaagagcaattttagggcatcaagtatgacaataatcatgtgccctcttgctcctcttatttcaggagtgtgtgctatccctctctccaccagcttaatctttctcaccccaagtctaacaaagtctttacagaaacctctgtaggtgattgttgcagtcttccttggtttttgagtctttttaaacaagctcctaccctgcttctatccttttagagtaggagattaaaaataaacccaccccagtcaacctttagataagcactcttaaaaacaaatttgaagagcactcttcagccaagttcatttttattttgttgttgatgttttgagcatacatttaattgtaaggccttttggaaaagccctaaaagaataagatacaaccagaaatatttgagttttgttaaatgtactgaaatcttgtaatgaaaatccctttggccagaaatgagatttatttccatttatttttacatttaagtaacactcaaaacaaacaagtagtcacttaacctgccagttattattttcttgaaaatatacaagaaagtaaaaatatctctaatatataagttaaaggaaagttaagagactaagctagttttttcagtgaaagcaaagttggaaatattttgcttctctcagattattggaagacctagagctactggatgttaacctgaatcaagatgttcttttcacatttttttaaagggctagtatgttccagagtaggcaagtagtcattcaagccaaatgaaagagttaactggtccttgaggagtgttagcaaaatttaaattttgaccctggccatttgtactacagaagtgattatgggattaaaagaatacataattacagtgttttgggattgggctcttttttttcttaatagaaaagcagaaacttcataaataatagctgtgctttagataccagataacaaatattgtttcccctgaagatatgacctactagaactactcacatatatagtccaataattactgacttaataggtatggtaaaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattat

SEQ ID NO: 173747 - DNA, 5834 bp, Homo sapiens
  Payload ID: 14120
  Gene Symbol: RALGPS2
  Gene Name: Ral GEF with PH domain and SH3 binding motif 2
  Uniprot ID: Q86X27
  ENST ID: ENST00000367635
  CDS Start-End: 339-2090
gccccgcccgcttggcgcgcgcccccgccaggtccgctctcgtcccccacccctggcgcggacggggtggttccagctcactctcctcccccgagcggcagcggcggcggcggcggcggctgctgcgggcgctgaatgagagacggtgactgttcgggtcgacgagtgctactctaggcggcggcggccgtggcggtgaagcgtgaggccggcatcgtctttccgtcctctgaggcgacggccgcggctgcacaggaataatgtatttgtggccttggacatgaggcagtcagtcctctgttgctgttaacataaggtcagggactgatgaggaaagcatggacctaatgaacgggcaggcaagcagtgtcaatattgcagctactgcttctgagaaaagtagcagctctgaatccttaagtgacaaaggctctgaattgaagaaaagctttgatgctgtggtattcgatgttcttaaggttacaccagaagaatatgcgggtcagataacattaatggatgttccagtatttaaagctattcaaccagatgagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataatttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtagcagcgatggttctgaactaagtgaagagacctcatggcctgcttttgaaaggaacagattataccattctctcggcccggtgacaagagtggcacgaaatggctatcgaagtcacatgaaggccagcagttctgcagaatcagaagatttggcagtacatttatatccaggagctgttactattcaaggtgttctcaggagaaaaactttgttaaaagaaggcaaaaagcctacagtagcatcttggacaaaatattgggcagctttgtgtgggacacagcttttttactatgctgccaaatctctaaaggctaccgaaagaaaacatttcaaatcaacatccaataagaacgtatctgtgataggatggatggtgatgatggctgatgaccctgaacatcctgatctcttcctgctgactgactctgagaaaggaaattcgtacaagtttcaagctggcaatagaatgaatgcaatgttatggtttaagcatttgagtgcagcctgccaaagtaacaaacaacaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaatcttcttattaagcctgccctcaattgtaaataagtgactcaaaaactcaaaatgttcatcagcattcaggtcatttgtttcacccttagccaagaagaactcattagaaattcagttataatttcaatttaagcctgtttatgataagcataatgattggcatgttatatagcctgttgaaaataactacagaatgaccttccagagcactgtttttggcctcgtgcccgctctgttcaggctctgcttgtttttcagaatatgatttttacctccagacagtaagaattgaacaagaactgatcaaacacaccttcctattttgttttcttcactatgtaaatattatttgggcaaacattacaaaaagggatccaaacaatttgagtttcagtatttttttctccctaggcatgtgcttcaatttcaaatatttttttctgtgtggaaaatgccatgtaactattgcactaccttctgtgtggactgtgttggtattggttctttctgtatatcaaaagtcagggtgtttataactgcaaagtttgtataagtggctttattcctcttctagaagatttatgaggagcctaggaagcactattggtacaggaggaaaaaagaatggaaaacatgtttacagactctagctttccttattagcttaaactggggccctcaaagagcagcctgttgatcttttggccaaatgacttgagcataagtcttttatttctttttaaggttaaatcgtaaactgtatacctttactactgaaaacaaaactatagggcatcatactaattgaaaatcaatagtaatgggttccatccattagctttttaaatgaatagatctggtattgatttccttcctgtttttttgaggcacattcctttacaaccagtgtttaaaccaccacgtaatcatcttctgcaaacaaggggtgccagtgttgcctaacagaagataatctttaataaagcaaatcctctgcttcaaaggtttttgaaataattggatccctttttgaaaaggaagatgagtttaactgtgtccaggtggagtaatagtactgctgttgcatgaatagatgatacaaagcaagtgatgaggttggtatgacttctttagtgaccttttagggtttgcttttattttcctctcttttttgtattatttctttcaaacatagtaaatatatgattttacagccaaa

SEQ ID NO: 173748 - DNA, 662 bp, Homo sapiens
  Payload ID: 14120
  Gene Symbol: RALGPS2
  Gene Name: Ral GEF with PH domain and SH3 binding motif 2
  ENST ID: ENST00000415888
  CDS Start-End: 1-298
tcagtatatagaagaactacaaaaatttgtggaagacgataattacaagctttcattaaagatagaaccagggacaagcaccccacgttctgctgcttccagagaagatttagtaggtcctgaagtaggagcgtctccacagagtggacgaaaaagtgtggcagctgaaggagccttgctcccacagacaccgccatcccctcggaatctgattccacatggacataggaagtgccatagtttgggttataagtcagcatttttaattttatctttcaaatttttaagtcttttgtaattggatttattgtcgatttattagttcagtagaaaatggtatccttgaatagttttcttttttcttaatagctgttttctgattcagtaaaatgccttgtttgcctaaaagcttttatttcttactttacctgaatttggaaatgggattttgtcaacaatgcatttatatttggggacgataaatgaacattacagagggccatcataaataaaatcaggatagcaatatacctttttaaaagagttacaacctttatatcaagacagtcattgtttgtcttaaccaaaataagtcaaaaataacagctataaaaattattttctttattcctaaatataaagaaaactgactttttgtttaa

SEQ ID NO: 173749 - DNA, 7911 bp, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENST ID: ENST00000307138
  CDS Start-End: 470-6721
atcactaccacactcgtctccgtttcggcctctgcagggtgtaagctgctaaagaagcttcaaccttaagggggcctcagggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcca

SEQ ID NO: 173750 - DNA, 6328 bp, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENST ID: ENST00000382366
  CDS Start-End: 100-6249
tctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagaggcagaacagaatgccaccagaggctccactgagggatctgtacagtcatgtaatgggctattttggaaggaaagctgcagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggg

SEQ ID NO: 173751 - DNA, 7864 bp, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENST ID: ENST00000389698
  CDS Start-End: 392-6502
agggagagagttgtgctcctgccgccgagagctccaccttcgtggctctgggtccggggccccggcctgtggcggcgagcggcggccgctggagacgagcggcggcggcaggcggccagcccgggtctgcctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcca

SEQ ID NO: 173752 - DNA, 2358 bp, Homo sapiens
  Payload ID: 14121
  Gene Symbol: RALGAPA1
  Gene Name: Ral GTPase activating protein, alpha subunit 1 (catalytic)
  ENST ID: ENST00000554573
  CDS Start-End: 1-1070
aaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgttgaaagaaatgcagtgatagttctcttcctcccaaaacctccgctagaaaacattggccatctcaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcctatcca

SEQ ID NO: 173753 - DNA, 3354 bp, Homo sapiens
  Payload ID: 14121
  Gene Symbol: RALGAPA1
  Gene Name: Ral GTPase activating protein, alpha subunit 1 (catalytic)
  ENST ID: ENST00000554259
  CDS Start-End: 1-2169
cagatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgttggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttcct

SEQ ID NO: 173754 - DNA, 6271 bp, Homo sapiens
  Payload ID: 14121
  Gene Symbol: RALGAPA1
  Gene Name: Ral GTPase activating protein, alpha subunit 1 (catalytic)
  Uniprot ID: Q6GYQ0
  ENST ID: ENST00000553892
  CDS Start-End: 1-6252
atgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaaggtcacaagtctcaaagagaggaattggatgctatactttttatttttgagaaaattttacaacttcttccagaaagaattcatcagcgatggcagtttcatagtattggattgattttaaagaagctacttcacacaggaaactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaaccttcaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcgtgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaaacagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacgcctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacagatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgctgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgccatgagaagccgatccattggtgaatgtgctctgccatcggcctatatacgcagtgctaaaagtgctcctgttctgatccatacttccaaacccttcttgcctgatattgttctcactcccctttctgatgagctttcagatattgatgatgctcaaatacttccccgctcaactagagtcagacatttttcacaaagtgaagaaactggaaatgaagtttttggtgctttgaatgaggagcagccattgcctcgaagtagcagcacttctgacatcttggaaccattcactgttgaacgagccaaagtcaataaagaggacatgagccaaaaactgcctcctcttaatagtgatattggcggcagcagtgctaatgttcctgatctgatggatgagtttatagcagaacgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccgaaaatttgacaattttggctttggaaccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgggctccaggtcacagactccttccccttctacattgaatatagatcacatggaacagaaggatctgcagctcgacgagaagctccaccactctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactgagaattcttacaccttggctttttaaggcaaccatgttgactgataaatataaacaaggtaaattacatgcatataaacttatttgtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatct

SEQ ID NO: 173755 - DNA, 6152 bp, Homo sapiens
  Payload ID: 14122
  Gene Symbol: RALGAPA2
  Gene Name: Ral GTPase activating protein, alpha subunit 2 (catalytic)
  Uniprot ID: Q2PPJ7
  ENST ID: ENST00000202677
  CDS Start-End: 9-5630
gccgcgggatgttctcccgaaggagccacggggatgtgaagaagtccacccagaaggtgctggacccgaagaaggacgtgctgacccgcctgaagcacctgcgggcgctgctggataatgtggatgcaaatgatcttaagcagttttttgagaccaactattctcagatatatttcatcttctatgaaaattttatagcactggaaaatagtttgaaattaaaagggaataataagtcacaaagggaggagctggactccatcctcttcctttttgaaaaaatactgcagtttctacctgaacgaattttctttcgatggcattaccagagtataggctcaactttaaagaagcttctacacactggaaattctattaagataagatgtgaaggaatcaggctgtttcttctgtggcttcaagcacttcagacaaactgtgcagaagagcaggttctgatttttgcttgcctggtgcctggtttcccagcagtcatgtcatccaggggcccttgcacactggagacactcatcaatcccagccctagtgtagctgatgtaaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacaaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacggattaaaacacgtaaaggtctcatttcaatatttgagcaaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgca

SEQ ID NO: 173756 - DNA, 2623 bp, Homo sapiens
  Payload ID: 14122
  Gene Symbol: RALGAPA2
  Gene Name: Ral GTPase activating protein, alpha subunit 2 (catalytic)
  ENST ID: ENST00000427175
  CDS Start-End: 1-752
ggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttgtatctttttgctttaaatgtgtaacttactaaccatcccagaatcaagattcctggcagtttttcataagaggtaagtattcaaaactgaattgaagagggaagagaatttttttcaacctctgttaaaaataacatagtggtttttcatagcatttgttaatttatattaaatataataattttatgctgcattaaacttagagtttactttcataatttactcacatacgtttgtgtctgagaagctgtgaccattatgagatgctcatatcttcttaggtattttgccccacgttcagtctcatcctgtatccctcttatttgtggcagtccattgtatataaggtgggatgctgagcaaaacgtatcgctcattcagagtgcctaccagaaaccaaagcaaatgaaatgaccctaataaatcaaagaatgtggcaggtaccacctgagaagtgcaagtaggtttctggaagatcagaggagatagaaattgcatttggttgagggtagagggaaagatgtcctgaattaagttgcatttggacttatcaataggaatagctagaaattcttttgtaattttcccaaatcattgatattttctctagttcctgattttgtttccaaaaacagaataaatttcactcctaaaattttttcctcaaacattaattggcctgctgtagtccttaaattcaagcatgatctcaagttataagaaaaagagattaagatgggtgaccttataaaattgatgcaaaaaaagtgacctcctaataaaacttagaatctctttgtttctaattggtattgataataatttgaaacatattgtgtttgacctctatatatacttctcccaacctgatagtaagtgatgtgttgctatagcaagtgagagttgggggtagatgaaaactatcccatgtgaatagatacggttcatgaaaaaatacctttcattaaaatcctggtcacttcattgactgatattctgcctttagattaaaaaaaaatacatatgccatgtggcaacttaaaattatcatagaaatgagtagtagaaaagagctattaggtcccatctggtccctcccctgggggccagggcaggattattcccttcagtgtactctctcgtgctttgtccaggctggtggtgagtgttttggagatggcattctttgcagtgatttccacaacactgtagacgtaatcttgtggctggtgtcaatttggccttcagcatggagtttttatttcacatactattaaaaagagcctcttggcagaaatgagaaagaactattcagcgattagtttgtcagtttgcatgtcaactaggacgagctgggcacgcatcagtcaagtatgttggaccaaggcagcaaaaaaaaaaaaaaaaaaaaaatcttattttacaaatgagaaaattccattttatattaattccattgtgacttttgtcatgtcaccttctctacttactgaacttctcattataaaatacttgctttgttattttgtttaacactgctttctcaaataagaattaatgtgatacaattggaatgatcaggtttagggaaaatggtatttttaaaagttcaaaggatactattcagaatcactttgaaaacttttcaagcagtgacacatcaggactaatgtggataccagctagggctactgatgctattgtgtgttagtaaatgtactctaactcacaaaatagctaacttgacatctcaaacaacaatgtagtacagaaattaggaaaaatattttaaaaactattatgttgatcattatcaatattttaaacttttttttgtcttgtacctggagaaaatttaattggtattattcaaataaattgtttaaaacaagaaa

SEQ ID NO: 173757 - DNA, 8769 bp, Homo sapiens
  Payload ID: 14122
  Gene Symbol: RALGAPA2
  Gene Name: Ral GTPase activating protein, alpha subunit 2 (catalytic)
  ENST ID: ENST00000430436
  CDS Start-End: 1-5222
taaagatatatccagaagaaatcactccactcctaccagccatatcaggggagaagattgctgaggaccaaacctgcttttttcttcaaatactgttgaagtatatggttattcaggctgcgagcttggagtggaagaataaggagaatcaagatactggttttaaatttctttttacattgtttcgaaagtattatcttcctcatttatttccatcatttactaagttaacaaacatctacaaacctgtacttgacatcccccatttgagaccaaagcctgtgtacattactaccactcgagacaatgagaacatttacagtacaaagattccatatatggcagctcgtgttgtttttattaagtggattgtaaccttctttttggaaaaaaagtatctaactgcaacacaaaacactaaaaatggagttgatgtattgcctaaaatcatccagactgttggtggtggtgctgtgcaggagagagcgcctgagctggatggtggtgggcccacggagcaggacaaaagccattctaacagcagcaccttgtcggaccgaagactcagcaactccagcctctgtagcattgaagaagagcaccgaatggtgtatgaaatggtacagcggattctcttgtcaacacgaggttatgtcaacttcgtgaatgaagtatttcaccaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatgggaacagatgttgcaaatactactcaggataacagaagctgtcatgcagaagccaaaggataaacaaataaaggacttgtttgcccagagcttggcagggttactatttaggacgctcatggtagcttggatccgagcaaacctctgtgtgtacatttctcgagagctctgggatgactttcttggtgtgctgtcctccctcacggaatgggaggaacttataaacgagtgggccaacattatggactccttgacagcagtgcttgcaagaaccgtttatggagttgagatgacaaacctacctctggataaattaagtgaacaaaaggaaaagaagcaacgaggcaaaggctgtgttctagatcctcagaaaggaaccaccgtggggaggtccttttctctcagctggcggagccacccagatgtgaccgaaccgatgcgatttaggagtgccaccacgtctggagcaccgggagtggaaaaggcaagaaatattgttcgccaaaaagcaactgaagtggaggagtgtcaacagtcagaaaatgcacctgcagccggatctggccatctcacagtgggacagcagcagcaggtccttcggagcagcagcacctccgacatccccgagccgctgtgctcagattcttctcagggtcaaaaggcagaaaacacacagaattcgagttcttcagagcctcagcctattcaagagaataaaggacatgtgaagagagaacatgaaggaataacaatcttagttcgaagaagcagcagccctgctgaattggatttgaaagatgatttgcagcagacacaaggaaaatgtagggaaagacagaagagtgaaagtaccaacagtgacacaactctgggctgtaccaatgaggcagagctgtccatgggcccatggcagacctgtgaggaagacccagaactgaatactcccacagatgttgtggctgatgctgatgcccgtcattggttacaactgagtcccaccgatgcttcaaatttaacagatagcagcgagtgcctcacagatgactgtagtataatcgccggggggagcctcactggttggcacccagactctgctgctgtgttatggcgaagggtcttggggatcctcggagatgtgaataacatccagtcacccaagatccatgccagagttttctgctatctctatgaactctggtacaaactagcaaagatacgggataatctagcaataagcctggataaccagtcttctccatctcctccagttttgatcccaccactcagaatgtttgcatcatggctgtttaaggcggcgacactgccaaatgaatataaggaaggcaaactacaagcctacaggctgatctgtgccatgatgaccagacgccaggacgttctgccaaactcagatttcctggtgcatttttaccttgtgatgcacctgggattaaccagcgaggatcaggatatcttaaatacgatcataaggcactgtccaccccgctttttctccctgggttttcctggcttctcaatgctggtgggggacttcatcacggccgctgccagggtccttagcacagacattttgacggcgcctcgttcagaggctgtcactgtcctcggctctctggtctgctttccaaatacctaccaggagattcctttactgcagtcagtgccagaagtaaatgaggccattacaggaactgaagatgtcaagcattacctcataaatattttactgaagaatgccacagaagaaccaaatgaatatgcaagatgcattgctgtttgctcccttggggtctggatatgtgaagagcttgcacagtgtacaagccaccctcaggtgaaagaggccatcaatgtgataggagtaactctgaagtttcccaacaaaatcgtggcccaggtagcttgcgatgtccttcagttgctggtttcctactgggagaagcttcagatgtttgaaacctctctgcctcggaaaatggcagaaatcctcgtggccacagttgcttttcttttaccaagtgcagagtactcctcagtggaaacagacaagaagtttattgtgtccttgctactctgcctcttggactggtgcatggcattgcccgtgagtgtccttctccaccccgtgtccacagcagtcctagaggagcagcattcggccagagcccccttgctggattatatctacagggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagaggagaagaagagaagaagtttggagttgatccctttgactgctcgaatggtgatggcccacctggtgaaccacctggggcactaccccctcagtgggggccctgccatactgcacagccttgtcagcgagaaccatgacaatgcccatgtggaaggctccgagctgtcctttgaggtgttcagaagtccaaacctgcagctgtttgtatttaatgatagcaccctcatctcctaccttcagacacccacagaaggaccggtagggggatcaccagtgggctctctctctgatgtgagagtaattgtgagggatatctcagggaagtactcttgggatggtaaggttttatatggacctttggaaggctgcttagcacccaatggaagaaatccttcatttctgatttcgagctggcatcgtgacacatttggacctcagaaagactcttctcaagttgaggagggggatgatgttcttgacaaattacttgaaaacattggccatacaagtcctgaatgccttttaccgtcacagctaaatctaaatgaaccttccctaaccccatgtggcatgaactatgaccaagagaaggaaatcattgaggtcattttgcgccaaaatgctcaagaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaataattcagaaccaccgcgaagtaatgacattcgaggatttcgcagcccaagtcttttctccctctcccagctactccctcagcggaacgggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgcattgattttgctagttccttttatgttaggatttatggtttactcaaaaatttcatcatcatggaaattggctttccccggggtcttttgcccaggagaagttttacctcagttgtccagtgttttcccacatggtacctgacgcccgctaactaagcagaggctctcctcaccacgcagaggcgcttcaggtcatgacagtgatgcccctatcttagaacactcagaagattccagaaatacagggtcctgtccttgcataagttcctgcaggacaggaagtgtcccaaggctcaaaacaacacagaccacatccacacaaaaggcgcatgccggcttcaggcgctaggctgagacgggtaccccccgaatggccttgtgcctccaaaagcctcacgctgcaactttgctgctcctgtctgttgcccagagaggcctcacacaggcctcagaaatgtttcttgtcacacaaagcttttggtagccgattccaagcgagggatttaatccttacatttttgcccatttggctccaaggaaggcttattagacctgtttttttgttgttgttgtttttttttcttaaaaacaaaatgaatgaatgaatgaaaagagaagcaatggtgagccctctcctgctggggcgccctgggtgggccttgcccgtcctgcagcagagaaatcagtcagcagcgaagagctgctggcgcaggccccaggctgtgtcctggacccttgacctgcctcagagctagaggtttgctccaccccgcacttcacttgggaagtaaatccaagaagcttaccagagtccatcgccactgcgcaggctttgttctcacagcggccaggtacagagcaacgccctgcagtgggaagggacagcagcacgagagacgcagcccctaactcagggcttatgatgggtgggctggtcctgggaaaggcgggccctgtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacagaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaataaaaa

SEQ ID NO: 173758 - DNA, 1432 bp, Homo sapiens
  Payload ID: 14122
  Gene Symbol: RALGAPA2
  Gene Name: Ral GTPase activating protein, alpha subunit 2 (catalytic)
  ENST ID: ENST00000620717
  CDS Start-End: 127-840
gaggatgagtatatccagagtcataacttcgattctgcaatgaaagtcaccagccaagggcagccctccccagtggagccccgaggacccttttatttctgcaggttattgcttgatgacttgggaatgaattcttgggacagaaggaagaattttcatctattgaagaaaaattcaaaattattgagagagctgaaaaatttggactcccgccagtgccgtgagacacacaaaatcgcagtgttttacattgctgaaggtcaagaagacaagtgttcaatcctctctaatgaaagaggaagccaagcatatgaagactttgttgctggacttggatgggaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaagcttcgtcacttggggaatgacgaggtccatatcgtctggtctgaacactccagagactaccgcaggggtattatcccaactgcctttggagatgtttcaatcattatttacccaatgaagaatcacatgttcttcatcgcgataacgaagaaacctgaggttccattttttgggcctctgtttgatggagccatagtgagtgggaagctgctgccaagccttgtatgtgccacgtgcatcaacgccagcagggctgtgaagtgcctcatcccactctaccagagcttctatgaagagcgagctctgtatctcgaagcaatattcagaaccaccgcgaagtaatgacattcgaggatttcgcagcccaagtcttttctccctctcccagctactccctcagcggaacggattaaaacacgtaaaggtctcatttcaatatttgagcaaggggccctggcctccagtctgagtgctgacctcgaagagcccctgagtgaggaggagacagaacaccctctcctgcctctgccccgagccactaaacccagaatctccaggaaatttcgttgctgtactagtgccctcagcaggtcttcccattagtggacttctgaagcccatggtgaatcccactaccgtgtctcagatgggactcaaactaggctgtatcatcttgtcctgaaacctcacaaaccttggacttccaaagaagaaaagaaaaagtcaccaaaaaccagagatgaacccactgacacgtgggcactggtgtggctgctctgggcagatgacagcaggaaaagattctgcgctttcagggagggggcagagggcagcttgcttctgcaccccaagttgtttcttctcatttatgaacccaagcatgattcacaaaggggctggcaaaacaattgtctaattgaggaatctgatctgc

SEQ ID NO: 173759 - DNA, 8663 bp, Homo sapiens
  Payload ID: 14123
  Gene Symbol: RALGAPB
  Gene Name: Ral GTPase activating protein, beta subunit (non-catalytic)
  Uniprot ID: Q86X10
  ENST ID: ENST00000262879
  CDS Start-End: 285-4769
gagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaataa

SEQ ID NO: 173760 - DNA, 8435 bp, Homo sapiens
  Payload ID: 14123
  Gene Symbol: RALGAPB
  Gene Name: Ral GTPase activating protein, beta subunit (non-catalytic)
  Uniprot ID: Q86X10
  ENST ID: ENST00000397040
  CDS Start-End: 59-4543
cttggcgccctgggagagtcgctgacgggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaat

SEQ ID NO: 173761 - DNA, 8652 bp, Homo sapiens
  Payload ID: 14123
  Gene Symbol: RALGAPB
  Gene Name: Ral GTPase activating protein, beta subunit (non-catalytic)
  Uniprot ID: Q86X10
  ENST ID: ENST00000397042
  CDS Start-End: 285-4760
gagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaat

SEQ ID NO: 173762 - DNA, 4075 bp, Homo sapiens
  Payload ID: 14123
  Gene Symbol: RALGAPB
  Gene Name: Ral GTPase activating protein, beta subunit (non-catalytic)
  ENST ID: ENST00000438490
  CDS Start-End: 1-3972
attaacgacatacttctggccccaccaactgttcaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccagattgctacgctttacatatggtccttcatttcctgcatttaaagttcccgatgaagatgccagtctgatccctccagaaatggataatgagtgtgttgcacagacatggtttcgctttttacacatgttaagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactgccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacagagaactctcaaaattcaaaagctatgtaaatccaacagaattgcgaagatcctccattaatatcctgctttctttgttgcccctccctcatcattttggcacagtcaaatctgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatgctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaa

SEQ ID NO: 173763 - DNA, 4858 bp, Homo sapiens
  Payload ID: 14123
  Gene Symbol: RALGAPB
  Gene Name: Ral GTPase activating protein, beta subunit (non-catalytic)
  ENST ID: ENST00000632792
  CDS Start-End: 1-2599
tgaggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggggcaatgttaaatattgttcaagattcagcacttttggaagccattggttgccagatggagatgggtggtggagaaaataacctgaagagtcatagtcgcaccaatagtggtattagttcagcaagtggtggaagcacggagcccacgactcccgatagtgagagacctgctcaagctctcttaagagattatggatcgacagctcttaatacagattcagctgctgggctcctgattcgcagcattcatctcgtcacccaaagactcaactcccagtggcgccaagacatgagcatatcactggcagctctagagctcctctctggccttgcaaaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatgcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagaatgattttttcccctctgtcactgtgctggtccggggaatgtctggaagacttgcttgggcacaacagctttgtcttttacccagaggagcaaaagcaaatcagaagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaattagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaagaagaagtgatttcctctgaagatattggagctagcattttcaatggacagaagaaggtgctgtattatgctgatgcccttacagaaattgcttttgtggttccttctcctgtggagtccttaactgattcattggaaagtaacatctcggaccaagatagtgattcaaatatggatcttatgccaggaattctgaaacagccatccctgacacttgagcttttccccaatcatacagacaatcttaattcctcacagaggctcagtcccagttccagaatgaggaagctgcctcagggtcgccctgttcctccccttggacctgagacaagagtttctgtagtctgggtggaacgctatgatgatatagaaaactttcccctctcagagctgatgacagagatcagtactggtgtggaaactactgcaaatagtagcacttcactgagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgct

SEQ ID NO: 173764 - DNA, 3598 bp, Homo sapiens
  Payload ID: 14124
  Gene Symbol: RALGDS
  Gene Name: ral guanine nucleotide dissociation stimulator
  Uniprot ID: Q12967
  ENST ID: ENST00000372047
  CDS Start-End: 23-2731
gcgcccgcgctgcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 173765 - DNA, 3634 bp, Homo sapiens
  Payload ID: 14124
  Gene Symbol: RALGDS
  Gene Name: ral guanine nucleotide dissociation stimulator
  Uniprot ID: Q12967
  ENST ID: ENST00000372050
  CDS Start-End: 23-2767
gcgcccgcgctgcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 173766 - DNA, 3596 bp, Homo sapiens
  Payload ID: 14124
  Gene Symbol: RALGDS
  Gene Name: ral guanine nucleotide dissociation stimulator
  Uniprot ID: Q12967
  ENST ID: ENST00000372062
  CDS Start-End: 75-2732
gctcagaggagcagggctgggagcgaggtgctgctggggcagtgtctgggcgggaagccgggccccagggcctgatgtgcctgtgggggcactccacagcccctgcccacaccctctcctccccgcctctgctgttctgctccctgccctgtgccctccacttgcagccagggactgggcatccacccggccaggttcccaggaagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctact

SEQ ID NO: 173767 - DNA, 3689 bp, Homo sapiens
  Payload ID: 14124
  Gene Symbol: RALGDS
  Gene Name: ral guanine nucleotide dissociation stimulator
  Uniprot ID: Q12967
  ENST ID: ENST00000393157
  CDS Start-End: 84-2825
actccactagggcacgcaggcgacgagcacactggcagagggcctcccgcagggcccactccccacctggctctcgccccaccatggcccgggaagcaggccaggtttgtgccaggcctgccgtgcccagggggaggaagggctctgtgttctttgcctgtgtctctgtggtgaccgccaggagaagggccgtcgcccgtcgtgccgctctccaaagcccgacaccttggctggcacctctgccagcaccggccaccaccgagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctact

SEQ ID NO: 173768 - DNA, 3801 bp, Homo sapiens
  Payload ID: 14124
  Gene Symbol: RALGDS
  Gene Name: ral guanine nucleotide dissociation stimulator
  Uniprot ID: Q12967
  ENST ID: ENST00000393160
  CDS Start-End: 355-2934
ccgagcgcgtccccgagctcacgcggcggggcgcgcccctcgcacctgcgggcgggctggggcggggccgcggctgtccccgcccacccgggcccgagcccggggagccggggcggaaccgagcggcgaggcccgagcggccggagcgcggcgcggcgcagacaatgggagcggcgctggcggctgccggggcggccccgagggccgcagagtcctgggcccggcggggaccggaggccgcgccatgagccccgcagccgggcgcacccctgcgccgcgcgcgggcccaggcgagcggcctctgcgagccccgggtcccgccctggggccggcgatgtgccaccgaggctgaggatgatggtagattgccagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 173769 - DNA, 926 bp, Homo sapiens
  Payload ID: 14124
  Gene Symbol: RALGDS
  Gene Name: ral guanine nucleotide dissociation stimulator
  ENST ID: ENST00000424572
  CDS Start-End: 1-926
gtggttgcagagaacgggctgagtgaggagaagcctcacctcttggtgttccctccagatctggtggcagagcagtttacactgatggatgcggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagac

SEQ ID NO: 173770 - DNA, 4602 bp, Homo sapiens
  Payload ID: 14124
  Gene Symbol: RALGDS
  Gene Name: ral guanine nucleotide dissociation stimulator
  ENST ID: ENST00000493438
  CDS Start-End: 3-2477
ccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtggagcacctggtgccagccttccagggcagcgacctctcctacgtcaccatcttcctgtgtacctatagagccttcaccaccacccaacaggtcctggacctgctgttcaaaagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctcccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcggtgctgtaggggaggtgaggtcagggaagtatccagggcctggccacataggccctgagccctgccaggacctcgactttctcggggaggaagacaggagcaatgatggctggcttctctgtctggtgtgggctggtaccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccagaggctgtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctaccgccaactatgactttgtcctcaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactata

SEQ ID NO: 173771 - DNA, 5100 bp, Homo sapiens
  Payload ID: 14125
  Gene Symbol: RGL1
  Gene Name: ral guanine nucleotide dissociation stimulator-like 1
  Uniprot ID: Q9NZL6
  ENST ID: ENST00000304685
  CDS Start-End: 450-2861
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggg

SEQ ID NO: 173772 - DNA, 4724 bp, Homo sapiens
  Payload ID: 14125
  Gene Symbol: RGL1
  Gene Name: ral guanine nucleotide dissociation stimulator-like 1
  Uniprot ID: Q9NZL6
  ENST ID: ENST00000360851
  CDS Start-End: 179-2485
gtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactgagaatgaaattgctttggcaagctaaaatgagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagtaacagacacagcaaaatcaccctctgaagggagggaccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactacgtttgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcttaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaaggg

SEQ ID NO: 173773 - DNA, 3278 bp, Homo sapiens
  Payload ID: 14126
  Gene Symbol: RGL2
  Gene Name: ral guanine nucleotide dissociation stimulator-like 2
  Uniprot ID: O15211
  ENST ID: ENST00000383204
  CDS Start-End: 497-2830
ccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctcatcctaccgacgaactagagaggacaacagaggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggagtgccggctgctccgaaacttctcttcagtttatgccgtggtgtcagccctgcagtccagccccatccacaggcttcgggcagcctggggggaagcaaccagggacagcctcagagtcttttccagcctctgccagattttctccgaggaggataattattcccagagtcgggagctgctcgtgcaggaggtgaagctgcagtctcctctggagccacactccaagaaggccccgaggtctggctcccggggtgggggtgtggtcccataccttggcaccttcctgaaggaccttgtgatgctggatgcagcctccaaggatgagttggagaatggatacatcaattttgacaagcggaggaaggagtttgcagtcctttctgagttgcgacggctccagaatgaatgtcgtggctataacctccaacctgaccatgatatccagaggtggctacaggggctccggccactgacagaggctcagagccatcgtgtatcctgtgaggtggagccacctggttccagtgaccctcctgccccacgggtgcttcggccaacattggtcatctcgcagtggacagaggttttgggctctgttggggtccctaccccgcttgtgtcctgtgaccggcccagtactgggggagatgaggcgcctacaactcctgctcctctgctgactcggctggcccagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgacaagccaggacaaggctccaagtgtcatcagtcgtgtccttaagaaaaacaatcgtgactctgcagtggcttcagagtatgagctggtacagctgctaccaggggagcgagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattcta

SEQ ID NO: 173774 - DNA, 640 bp, Homo sapiens
  Payload ID: 14126
  Gene Symbol: RGL2
  Gene Name: ral guanine nucleotide dissociation stimulator-like 2
  ENST ID: ENST00000412959
  CDS Start-End: 201-640
accaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggcccctgtgtccgtctgggatgaggaggaggatggtgccgtgtttaccgtcacaagccgccaatatcgacctcttgatcccttggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggctggaagcccttgaatctca

SEQ ID NO: 173775 - DNA, 3278 bp, Homo sapiens; identical to SEQ ID NO: 173773
  Payload ID: 14126
  Gene Symbol: RGL2
  Gene Name: ral guanine nucleotide dissociation stimulator-like 2
  Uniprot ID: O15211
  ENST ID: ENST00000452084
  CDS Start-End: 497-2830

SEQ ID NO: 173776 - DNA, 640 bp, Homo sapiens; identical to SEQ ID NO: 173774
  Payload ID: 14126
  Gene Symbol: RGL2
  Gene Name: ral guanine nucleotide dissociation stimulator-like 2
  ENST ID: ENST00000425946
  CDS Start-End: 201-640

SEQ ID NO: 173777 - DNA, 640 bp, Homo sapiens; identical to SEQ ID NO: 173774
  Payload ID: 14126
  Gene Symbol: RGL2
  Gene Name: ral guanine nucleotide dissociation stimulator-like 2
  ENST ID: ENST00000455072
  CDS Start-End: 201-640

SEQ ID NO: 173778 - DNA, 640 bp, Homo sapiens; identical to SEQ ID NO: 173774
  Payload ID: 14126
  Gene Symbol: RGL2
  Gene Name: ral guanine nucleotide dissociation stimulator-like 2
  ENST ID: ENST00000431976
  CDS Start-End: 201-640

SEQ ID NO: 173779 - DNA, 3278 bp, Homo sapiens; identical to SEQ ID NO: 173773
  Payload ID: 14126
  Gene Symbol: RGL2
  Gene Name: ral guanine nucleotide dissociation stimulator-like 2
  Uniprot ID: O15211
  ENST ID: ENST00000413136
  CDS Start-End: 497-2830

SEQ ID NO: 173780 - DNA, 3278 bp, Homo sapiens; identical to SEQ ID NO: 173773
  Payload ID: 14126
  Gene Symbol: RGL2
  Gene Name: ral guanine nucleotide dissociation stimulator-like 2
  Uniprot ID: O15211
  ENST ID: ENST00000416548
  CDS Start-End: 497-2830

SEQ ID NO: 173781 - DNA, 640 bp, Homo sapiens; identical to SEQ ID NO: 173774
  Payload ID: 14126
  Gene Symbol: RGL2
  Gene Name: ral guanine nucleotide dissociation stimulator-like 2
  ENST ID: ENST00000446570
  CDS Start-End: 201-640

SEQ ID NO: 173782 - DNA, 3278 bp, Homo sapiens; identical to SEQ ID NO: 173773
  Payload ID: 14126
  Gene Symbol: RGL2
  Gene Name: ral guanine nucleotide dissociation stimulator-like 2
  Uniprot ID: O15211
  ENST ID: ENST00000497454
  CDS Start-End: 497-2830

SEQ ID NO: 173783 - DNA, 2542 bp, Homo sapiens
  Payload ID: 14127
  Gene Symbol: RGL3
  Gene Name: ral guanine nucleotide dissociation stimulator-like 3
  ENST ID: ENST00000380456
  CDS Start-End: 65-2197
acccgccacccgccggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccccagtagaggccactgtgctgtgtatcccaggaccaccacccaactgtagcccattggaccccatctctttttctgactctgttggtactagatccatattccaaagacatcagcccatgggtggctggtggagagctcaatcccataaatgtagaaagaggtggggcatggatacgtcaaatccctccccagagaaatcttataaatgttagagacgcatcagaagtgacagatgcggatgaaaatagtgaccagagttatgaaacag

SEQ ID NO: 173784 - DNA, 2278 bp, Homo sapiens
  Payload ID: 14127
  Gene Symbol: RGL3
  Gene Name: ral guanine nucleotide dissociation stimulator-like 3
  Uniprot ID: Q3MIN7
  ENST ID: ENST00000393423
  CDS Start-End: 51-2201
ggcccttccgcctcactcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagcctctgcatctcccccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctgaggcagccctgtcctctccacaagacacaagtcccacaggcaagcttgcgactcttctcctggaaagctgccatcccc

SEQ ID NO: 173785 - DNA, 2303 bp, Homo sapiens
  Payload ID: 14127
  Gene Symbol: RGL3
  Gene Name: ral guanine nucleotide dissociation stimulator-like 3
  ENST ID: ENST00000562663
  CDS Start-End: 1-751
gcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccact

SEQ ID NO: 173786 - DNA, 2366 bp, Homo sapiens
  Payload ID: 14127
  Gene Symbol: RGL3
  Gene Name: ral guanine nucleotide dissociation stimulator-like 3
  ENST ID: ENST00000563726
  CDS Start-End: 33-578
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacagttgtttctggccaggtgttgtggcacatgcctatagtcccagctacttaggatgctgagatgggaggatctcttgactccgggaaatcaaagctgccgtgagctgtgagcatgcccctgcactccaggcgatagagctgggggaaggaggaatagttgtttcttcaaattgaaatccaaagatctactcaaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccac

SEQ ID NO: 173787 - DNA, 537 bp, Homo sapiens
  Payload ID: 14127
  Gene Symbol: RGL3
  Gene Name: ral guanine nucleotide dissociation stimulator-like 3
  ENST ID: ENST00000567080
  CDS Start-End: 37-537
actcagcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggaccaccctcaggatttccgagaccaccctgcccattcggacctgggcagtgtccgaacctttctgggctgggcgg

SEQ ID NO: 173788 - DNA, 557 bp, Homo sapiens
  Payload ID: 14127
  Gene Symbol: RGL3
  Gene Name: ral guanine nucleotide dissociation stimulator-like 3
  ENST ID: ENST00000567431
  CDS Start-End: 29-557
aggaagggaggggctcggaggcgaccagatgaggcgaccaggtagaaaggggactgggggcggccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacag

SEQ ID NO: 173789 - DNA, 501 bp, Homo sapiens
  Payload ID: 14127
  Gene Symbol: RGL3
  Gene Name: ral guanine nucleotide dissociation stimulator-like 3
  ENST ID: ENST00000589032
  CDS Start-End: 1-232
cttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctaca

SEQ ID NO: 173790 - DNA, 2885 bp, Homo sapiens
  Payload ID: 14128
  Gene Symbol: RGL4
  Gene Name: ral guanine nucleotide dissociation stimulator-like 4
  Uniprot ID: Q8IZJ4
  ENST ID: ENST00000290691
  CDS Start-End: 1171-2592
taaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 173791 - DNA, 2420 bp, Homo sapiens
  Payload ID: 14128
  Gene Symbol: RGL4
  Gene Name: ral guanine nucleotide dissociation stimulator-like 4
  ENST ID: ENST00000401461
  CDS Start-End: 1114-2127
taggcgatgctcgagagaacaacatgttctcctgctgtatcccgacatgctgccgacctcctcgtcgcacaagaggccaaaatgagagtctttcccgagaatatagacattggttcaaccctcaccctcgacgcctctggccctttgccagaaggcacccacaggtaacacagggcccagggcaggcccatccaggctaggcctcagctgtgcccatcagggcagcctcaggcccctccccacttgtttgggggaaacaggagatgaggggccctccctggataggagcaggtaggttgtcaggtgtttggagcctggtaggtatgtcaggttcacagcccaggcagtgcctggcaggatgggaaggtgagtgtcaaggacacagtttgtctgctcagatctgaatcccaagtcctcaagctgtcatctgccggagacctcaggcttctctggctggaggtctatgcagatgctcctatgtgccaaatcctgttggggaagggggtgccagggatgagttctaatgggggtgtcccactgtggggtcagccagacaggccactgacacctcttggcccggctctcgggcactctctttgcagagctccacacaacagaccaaacaagagctgttggatggattcaatttctccatattcttcaaagggcacgtgcaccacaccaccaaccacgtccagtgccggtctgcgtatgaaaatgagatctgcaggatgctaactttccagcccggcactggggagaagctgttgggagtccctggttccagcctttctaactaaacccatctcctcctatgccacctgcctgggcccctcctgggactttatcactgtgccacactttttggaactactggttagaagcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 173792 - DNA, 759 bp, Homo sapiens
  Payload ID: 14128
  Gene Symbol: RGL4
  Gene Name: ral guanine nucleotide dissociation stimulator-like 4
  ENST ID: ENST00000452208
  CDS Start-End: 1-466
ctgggccagtggtatgagcacggtgccaggtggctcccgccactccctggggatccaagtgcggggtggctggggtgtaactgggggagaggaggagagcctcactgtccctgtcgctgacacctggcaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 173793 - DNA, 3779 bp, Homo sapiens
  Payload ID: 14128
  Gene Symbol: RGL4
  Gene Name: ral guanine nucleotide dissociation stimulator-like 4
  ENST ID: ENST00000441897
  CDS Start-End: 1609-2916
acttcgtaggcgatgctcgagagaacaacatgttctcctgctgtatcccgacatgctgccgacctcctcgtcgcacaagaggccaaaatgagagtctttcccgagaatatagacattggttcaaccctcaccctcgacgcctctggccctttgccagaaggcacccacagctctcgggcactctctttgcagagctccacacaacagaccaaacaagagctgttggatggattcaatttctccatattcttcaaagggcacgtgcaccacaccaccaaccacgtccagtgccggtctgcggtgagattgggcacagaagggtctccacagacaggacttgtgaaaaccaagtatgaaaatgagatctgcaggatgctaactttccagcccggcactggggagaagctgttgggagtccctggttccagcctttctaactaaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaagagggatgacggtgagaacaacggcaacagctacaggaaactgagccctcagaggccctgtgaggtagctgtggtttgcatcactctttacagaagaggaaacagtctcagggaggcccggctgcaagactgggtgacacacacagggagtgtggatctgggccagtggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagatggggtttcacgatgatgtccaggatcgtctcaaactcctggcctcaagcaatccacccacctcagcctcccaaagtactgacgttacaggtgtgagccaccccacctggcctagaggaggctctcccgtggccagctgcagagagcctatggccatgcctccacggccagcatcaagccctgttgcatggggaccactggggacccaggattccagctgggcaggcactgacaggggacctgatgtgtggctcatggtggcctcacagctgcttctctgtcctgcagctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattcaaaat

SEQ ID NO: 173794 - DNA, 2333 bp, Homo sapiens
  Payload ID: 14128
  Gene Symbol: RGL4
  Gene Name: ral guanine nucleotide dissociation stimulator-like 4
  ENST ID: ENST00000423392
  CDS Start-End: 726-2333
ttccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagatggggtttcacgatgatgtccaggatcgtctcaaactcctggcctcaagcaatccacccacctcagcctcccaaagtactgacgttacagctacaagctgtcctgccagctggagcccgaaaacccgtaggctggcaacatcctgcagtggctgggaacccaccgggatgctggccagaacaccggctctgcaccatccctcacccagaccgtagacaccaggga

SEQ ID NO: 173795 - DNA, 3014 bp, Homo sapiens
  Payload ID: 14128
  Gene Symbol: RGL4
  Gene Name: ral guanine nucleotide dissociation stimulator-like 4
  ENST ID: ENST00000615003
  CDS Start-End: 1579-2811
taaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagaggctgcactgcagtgtcaccatctctgttcactgcaacgtctgccttctgggctcaagtccttcctcagcctcccaagcagctgggactaccgctgtacaccaccatgtccggttgttctgctgttgttgttctgctacaagctgtcctgccagctggagcccgaaaacccgtaggctggcaacatcctgcagtggctgggaacccaccgggatgctggccagaacaccggctctgcaccatccctcacccagaccgtagacaccagggaaccacatctaggaggctggcagctcagctgcatcttgccctggatcctcatcaccaactgctcctgctggccaggatcaggccatgggacttttgtgagtcaggcgggagaccattttatgtttattttctttagtgtataagtaagggttttttcttaactttcgttaaaataaaattttaaaaaactattc

SEQ ID NO: 173796 - DNA, 2649 bp, Homo sapiens
  Payload ID: 14128
  Gene Symbol: RGL4
  Gene Name: ral guanine nucleotide dissociation stimulator-like 4
  ENST ID: ENST00000612432
  CDS Start-End: 1579-2649
taaacccatctcctcctatgccacctgcctgggcccctcctgggactttatcactgtgccacactttttggaactactggttagaaggtgagtgtccatccccctccaagacacagaggtgcctctgtcccctactggctctgtcttgaagatgcacctctcggagcctcggttggctcctctggaacagggagtagtgagaagacgaacctcacagggttcttgtagggactcaatgatctaagacacagcaaacaaaggggtccctagagcctaaaactctggaaaatctgctgggggtgctgtgattcatgtttgttacttttctcttccccctcacttgaagcagctctcagcattctgcctcaatggcctgtatcactcactgtttggaaaaacacatagaaaccaagtctgcgatggcactggtaaaggatgtctgagattccttctggctggtctttctccttgacacagacagaagaggggtcccttggtgctgaaaaaggagccacaggcccactcagacatctggagaggctcactggggttctccaaaggttggggttcactcattcaacacatacattcaaaacacctcatttgtgcatcgctcttcttggggcttggcataatttcataaacaaagcagatgacaatcccccggccttgattctactcagagtcaggcactcacagtagacagaataaacaagtcatatctacagaatgttacaggtgagaccctcatggcctcctctacgtatggtggcatcctcccagattctgactagaatgacgcagcccagcaacaaatataaactgggtggatttagggttctgaagggccttttcacccacaaaacatgggggaaaatatgtggactctggctggggagagactaaaggagctctggggctcatacttcttataattcccacgagaaggctgacatctggggacttcccccacaagaggcaaatagtgagttctgtaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgatgaggaagctgctcacaaatctgcctgcagctgcagtcttgagtgcccaggtgtacagtgctgtgctccagggcctttgggaagagaatgtctgtgggacgccagggcgcacgagggtctgtacagccctgctgtatggccaggtctgccccttccaggacagcactgatggcttacgcaccatcacctccattttgttcaactggccccccgaaaacacttcagtttactatcagcccccgcaacggtcatctttccggataaagctggccttcaggaacctctcctggcctggactgggcttggaggaccatcaggaaattgtcctaggccagttggtgcttccggagcccaacgaggccaagccagatgatcctgctccacgtcctgggcaacacgcattaacaatgccggccctggagccagcaccaccactgctggcggacctggggcctgctctggagccagagtcacctgcagccctgggtccaccaggatatctacattcagcaccagggccagcaccagcaccaggggaagggccccctccagggacagtgctggagccacagtcagccccagagtcctcctgtccctgtcgtgggtctgtaaagaaccaacccagtgaggagctgcctgacatgacgaccttccctcccaggctgctggcagagcagctgaccctcatggatgcggagctgttcaagaaggtggtgctccacgaatgcttgggctgcatctggggccaaggacatctgaaggggaatgagcacatggcacccacagttcgtgccaccatcgcacacttcaacaggctcaccaactgcatcaccacctcctgcctcggggaccacagcatgagggcccgggacagggccagggtggtggagcactggatcaaggtggccagggagtgcctaagcctcaacaacttctcctcggtgcacgtcatcgtctctgctctgtgcagcaacccaataggtcagctacacaagacgtgggcaggagtgtccagcaaaagcatgaaagagctaaaagaactctgcaaaaaagacactgcagtgaagagggacctactgatcaaggcggggagctttaaggtggccacccaggagaggaacccccagagagtccagatgaggctgcggaggcagaagaagggtgtggtccccttcctgggggattttctgactgagttacagaggctggattcggccatcccggacgacctggatggcaacaccaacaagaggagcaaggaggtccgagttctgcaggaaatgcagctgctccaagtggctgccatgaattacaggcttcggcctcttgagaaatttgtcacctatttcacaagaatggagcagctcagtgacaaagagagatggggtttcacgatgatgtccaggatcgtctcaaactcctggcctcaagcaatccacccacctcagcctcccaaagtactgacgttacaggtgtga

SEQ ID NO: 173797 - DNA, 4368 bp, Homo sapiens
  Payload ID: 14129
  Gene Symbol: RALBP1
  Gene Name: ralA binding protein 1
  Uniprot ID: Q15311
  ENST ID: ENST00000019317
  CDS Start-End: 224-2191
agtctggtttaactggttggaacgactaaagcacgctggcgcaaggaaagctctcaacttcgggagctgaggcgcaggctggccagagcgtggagaggaaagccctttccatcctcaaggccgttgcaggagatgcccgcgagccaccttcgccagcaccacaccggggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaa

SEQ ID NO: 173798 - DNA, 4224 bp, Homo sapiens
  Payload ID: 14129
  Gene Symbol: RALBP1
  Gene Name: ralA binding protein 1
  Uniprot ID: Q15311
  ENST ID: ENST00000383432
  CDS Start-End: 78-2045
ggtcgcgcggcggcaggcacaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcattcggctgccagccgttttccgtgaatgtatagattacgtagagaagtatggcatgaagtgtgaaggcatctacagagtatcaggaattaaatcaaaggtggatgagctaaaagcagcctatgaccgggaggagtctacaaacttggaagactatgagcctaacactgtagccagtttgctgaagcagtatttgcgagaccttccagagaatttgcttaccaaagagcttatgcccagatttgaagaggcttgtgggaggaccacggagactgagaaagtgcaggaattccagcgtttactcaaagaactgccagaatgtaactatcttctgatttcttggctcattgtgcacatggaccatgtcattgcaaaggaactggaaacaaaaatgaatatacagaacatttctatagtgctcagcccaactgtgcagatcagcaatcgagtcctgtatgtgtttttcacacatgtgcaagaactctttggaaatgtggtactaaagcaagtgatgaaacctctgcgatggtctaacatggccacgatgcccacgctgccagagacccaggcgggcatcaaggaggagatcaggagacaggagtttcttttgaattgtttacatcgagatctgcagggtgggataaaggatttgtctaaagaagaaagattatgggaagtacaaagaattttgacagccctcaaaagaaaactgagagaagctaaaagacaggagtgtgaaaccaagattgcacaagagatagccagtctttcaaaagaggatgtttccaaagaagagatgaatgaaaatgaagaagttataaatattctccttgctcaggagaatgagatcctgactgaacaggaggagctcctggccatggagcagtttctgcgccggcagattgcctcagaaaaagaagagattgaacgcctcagagctgagattgctgaaattcagagtcgccagcagcacggccgaagtgagactgaggagtactcctccgagagcgagagcgagagtgaggatgaggaggagctgcagatcattctggaagacttacagagacagaacgaagagctggaaataaagaacaatcatttgaatcaagcaattcatgaggagcgcgaggccatcatcgagctgcgcgtgcagctgcggctgctccagatgcagcgagccaaggccgagcagcaggcgcaggaggacgaggagcctgagtggcgcgggggtgccgtccagccgcccagagacggcgtccttgagccaaaagcagctaaagagcagccaaaggcaggcaaggagccggcaaagccatcgcccagcagggataggaaggagacgtccatctgagcagcctgcgtggccgtctggagtccgtgagactgaaaggacccgtgcatcttactgtaacccgggggccaggccggctctctcgctgtacattctgtaaaggtgtcttctcttctcagactcttcctctgtcacacgtctgactccttcacgtcaggctcaggttccatgggaggacgaagcagtggacgcattgtgggctttagggacagatgagttttccagatagtgtcagcttatttgaagattaattttctttgttaacttaaaataactattttaacccttgagtggcttctttttaaaccaaaaaccgtctttctttgcttttttatcacagcagaatcaggatctctttctcattcaaggggggaaccaccccaggtcagcgctgcgcctgctgtggccgccgcgagccacgccctctgggatctctggtaccgtcactcttgcttgtgccttccacaccttctcggtgcagatccctatgggggagctgcctcacgttctctgactggtcagagcagcgcctggtgggtgttccctggcccactctcctctctccttctgcagttctaaaccacagtctataagcccgagtcaccaggacggcctgtctggccacagacaggggctgcctgtggagcctgcccaccggcccccggcagtgcagtccagcggggaggaggctgcccgttcctgccagttcctcactgcggggaccagcaaaggccttctcactgggttggtcaaaggtagtcaccttggcctggtgcatccacagaggatgttgttcaaaccagaaatcttttaaacgactgaccttccttaaaaacagaatgactccgattgcttgcttgggctagaatgtacacgtctccttgcctgaataagccatatatatgctcttaaacaaaagtttgaaattatccatatcatctcagtgaacctactggtggactcccaattgacaagattgagcaatagaaaaaaattcctttcctttgaatgatagctgtgattcaccccaccccattttcttgtttctggtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaagaaaagcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggcggcatgcctcccttccacaagcccatgctgctgcagagggagcctgtgtttgcaaaacccagtggactgggctgggtctgctgtctgagcagctcctggctccggtgggaactgcacacaagtccactggcctggcttggccccaggcattgcaattgacagacatttgcatttcatacggtaaatgaggactcagcacagccaaccataatcagcatgtctgggatagactggtctagaataaaaatgaagtttccattgctttgtttgctttaaaaattccacaattaaaatatctgtcattgaaagcttagacaaaca

SEQ ID NO: 173799 - DNA, 836 bp, Homo sapiens
  Payload ID: 14129
  Gene Symbol: RALBP1
  Gene Name: ralA binding protein 1
  ENST ID: ENST00000458039
  CDS Start-End: 216-836
ctcctggtgtcgcccaccgctggcactgagcagtgggcgcctttgggtgctgcgatccttccttcaggtttcagtgggaatggacagacagatctgaagttgaaaattcttttcacaactcatgttcaactatgtgtgttgtcagaatgctcttaatgaggtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctcaaacccatttttggaattcctttggctgatgcagtagagaggaccatgatgtatgatggcatt

SEQ ID NO: 173800 - DNA, 503 bp, Homo sapiens
  Payload ID: 14129
  Gene Symbol: RALBP1
  Gene Name: ralA binding protein 1
  ENST ID: ENST00000577221
  CDS Start-End: 493-503
gtcgcccaccgctggcactgagcagtgggcgcctttgggtgctgcgatccttccttcaggtttcagtgggaatggacagacagatctgaagttgaaaattcttttcacaactcatgttcaactatgtgtgttgtcagaatgctcttaatgaggttggagtgcaatggcatgatctcagctcaccacagcctctgcctcctgggttcaaacgattctgctgcctcagcctcctgaggggattacaggcatgcgccatcacgcccggctaattttatatttttagtagagacattttctccatgttggtcaggctggtcttgaactcccgacctcaggtgatctgcccgcctaggcctcccaaagcgctgggattacaggcgtgtgccaccgcgccctgccaacagtagtagcttttgagaagtgactctttaaacaaggtgtaatggataggtaacagagaagacctcgtcccttcctagtcagggcatcagcatgactgagtg

SEQ ID NO: 173801 - DNA, 777 bp, Homo sapiens
  Payload ID: 14129
  Gene Symbol: RALBP1
  Gene Name: ralA binding protein 1
  ENST ID: ENST00000585015
  CDS Start-End: 220-777
gcggcggcagcgtgagcgcgaggaggcggaggctgcggcggggcggacggtcgcgcggcggcaggcacagagatggagttttgctgtgttgcccaggctggtcttaaactttgagctcaggcagtccaccctcctcggcctcctaaagtgctgggattacacgtgtgtaatggataggtaacagagaagacctcgtcccttcctagtcagggcatcagcatgactgagtgcttcctgccccccaccagcagccccagtgaacaccgcagggtggagcatggcagcgggcttacccggacccccagctctgaagagatcagccctactaagtttcctggattgtaccgcactggcgagccctcacctccccatgacatcctccatgagcctcctgatgtagtgtctgatgatgagaaagatcatgggaagaaaaaagggaaatttaagaaaaaggaaaagaggactgaaggctatgcagcctttcaggaagatagctctggagatgaggcagaaagtccttctaaaatgaagaggtccaagggaatccatgttttcaagaagcccagcttttctaaaaagaaggaaaaggattttaaaataaaagagaaacccaaagaagaaaagcataaagaagaaaagcacaaagaagaaaaacataaagagaagaagtcaaaagacttgacagcagctgatgttgttaaacagtggaaggaaaagaagaaaaagaaaaagccaattcaggagccagaggtgcctcagattgatgttccaaatctc

SEQ ID NO: 173802 - DNA, 3161 bp, Homo sapiens
  Payload ID: 14130
  Gene Symbol: REPS1
  Gene Name: RALBP1 associated Eps domain containing 1
  Uniprot ID: Q96D71
  ENST ID: ENST00000258062
  CDS Start-End: 580-2967
ccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcg

SEQ ID NO: 173803 - DNA, 2607 bp, Homo sapiens
  Payload ID: 14130
  Gene Symbol: REPS1
  Gene Name: RALBP1 associated Eps domain containing 1
  Uniprot ID: Q96D71
  ENST ID: ENST00000367663
  CDS Start-End: 94-2403
ccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggag

SEQ ID NO: 173804 - DNA, 2511 bp, Homo sapiens
  Payload ID: 14130
  Gene Symbol: REPS1
  Gene Name: RALBP1 associated Eps domain containing 1
  Uniprot ID: Q96D71
  ENST ID: ENST00000409812
  CDS Start-End: 200-2317
ggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcg

SEQ ID NO: 173805 - DNA, 4537 bp, Homo sapiens
  Payload ID: 14130
  Gene Symbol: REPS1
  Gene Name: RALBP1 associated Eps domain containing 1
  Uniprot ID: Q96D71
  ENST ID: ENST00000450536
  CDS Start-End: 576-2966
cgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggagggtagattgtgtttgttggcacacccaccttttctgttccctagcatctgggatatgcaatgcttctatggctaataccacacaccaatttaatttatagaatgggctcctcatttacatctcagtcacagactcagaaataaattgtcagtttgtccttttatgtttaatattttacataaagcatctattctataaaaatctttagaaagagtttcccatttaattttgattttaaagaattatattggataaggtggttttcaccataagctaatttactctctgcagccgtctacattcttcacaaatcatgtggtacattgaagcctcttttacatgtcaacttgtgacaaatacaaacatgtgagattttatattttccttgtggaaatgtgatcaacttcatcagcgacttcgaactattttatgagattcaataattcagcagtcatgtaaacttatgaaataggtatgagtaatggcctttcttaatttttttaagtattgttttaaaacttctgaggatatcagttattcccagaataaagggaaattccttaggatttctagtttacctttagccatcttgtcactcattcttttgctatacagacaagtttttcctattaatgagtttctggagtatgccttattcaggacaatatgctgttttagattttgtttaatattaaatgatatatacatttcgatccattgctaacagcagatattccctttaagatttattctgtctataggatcatagattttaaactgcatggatatatcttggcagaatcagaagtgtggttttacaccaataaaacagcataatattttaacttttgttcatctttttaacaagatttaaagttttaagaaatagaagattttgtattttcatttctgaaagaaaaaatgtttaaatactatagattcacagtcctaaactgcaccgatagactttgttactgtaaacaagaatttgaagaacaagggaaactgacaacctcaagcttccaagattaatacaatttttacctgacaatatctaggtaaaaatatacatcagctgaagtttccaagtggctttcagtatggctttagttgttaaataataaatttaaagcattaaaggcccaggaaactactcaacacctgtttttctgagtgtctttgttttcaaagaaacatttttactcagctgtatttcattacaagcaagttttgctgtttccatttagttttgttttttaaaatatgctttttaaaaatagccttctaatttaacaatgtcaaaaatatttgttaaagcttcttagaatttagccttccaataaataacacttaaaaattatagaaaa

SEQ ID NO: 173806 - DNA, 2424 bp, Homo sapiens
  Payload ID: 14130
  Gene Symbol: REPS1
  Gene Name: RALBP1 associated Eps domain containing 1
  ENST ID: ENST00000415951
  CDS Start-End: 39-2252
tgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcga

SEQ ID NO: 173807 - DNA, 2690 bp, Homo sapiens
  Payload ID: 14130
  Gene Symbol: REPS1
  Gene Name: RALBP1 associated Eps domain containing 1
  ENST ID: ENST00000445570
  CDS Start-End: 530-1192
gtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcagggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctgga

SEQ ID NO: 173808 - DNA, 838 bp, Homo sapiens
  Payload ID: 14130
  Gene Symbol: REPS1
  Gene Name: RALBP1 associated Eps domain containing 1
  ENST ID: ENST00000431346
  CDS Start-End: 1-444
actccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagccctgatgctctgatgatgtcaggggcagagcagaacccacaggagggaggcagggttgacacagtgttccagcaggaggctaggttggaacactgcatcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatccca

SEQ ID NO: 173809 - DNA, 578 bp, Homo sapiens
  Payload ID: 14130
  Gene Symbol: REPS1
  Gene Name: RALBP1 associated Eps domain containing 1
  ENST ID: ENST00000414243
  CDS Start-End: 1-307
aacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagccctgatgctctgatgatgtcaggggcagagcagaacccacaggagggaggcagggttgacacagtgttccagcaggaggctaggttggaacactgcatcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcagg

SEQ ID NO: 173810 - DNA, 523 bp, Homo sapiens
  Payload ID: 14130
  Gene Symbol: REPS1
  Gene Name: RALBP1 associated Eps domain containing 1
  ENST ID: ENST00000530575
  CDS Start-End: 1-365
gacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccagggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagccctgatgctctgatgatgtcaggggcagagcagaacc

SEQ ID NO: 173811 - DNA, 619 bp, Homo sapiens
  Payload ID: 14130
  Gene Symbol: REPS1
  Gene Name: RALBP1 associated Eps domain containing 1
  ENST ID: ENST00000478483
  CDS Start-End: 1-458
cagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgtttt

SEQ ID NO: 173812 - DNA, 2468 bp, Homo sapiens
  Payload ID: 14130
  Gene Symbol: REPS1
  Gene Name: RALBP1 associated Eps domain containing 1
  ENST ID: ENST00000529597
  CDS Start-End: 1-2265
tcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctgga

SEQ ID NO: 173813 - DNA, 439 bp, Homo sapiens
  Payload ID: 14130
  Gene Symbol: REPS1
  Gene Name: RALBP1 associated Eps domain containing 1
  ENST ID: ENST00000530255
  CDS Start-End: 1-439
gagctgaatcagagcagtgagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagc

SEQ ID NO: 173814 - DNA, 299 bp, Homo sapiens
  Payload ID: 14130
  Gene Symbol: REPS1
  Gene Name: RALBP1 associated Eps domain containing 1
  ENST ID: ENST00000526022
  CDS Start-End: 1-185
aagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggtaatatagtttctgaatctttataatgttccttatcttagtaaagaaacctaaagagaaggaatgtgacctcagatacctccaagatcacatatatggttctcttctctaattttctagatg

SEQ ID NO: 173815 - DNA, 6069 bp, Homo sapiens
  Payload ID: 14130
  Gene Symbol: REPS1
  Gene Name: RALBP1 associated Eps domain containing 1
  ENST ID: ENST00000483468
  CDS Start-End: 320-982
gcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcagggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggttagcaaagctttccttttctttcattaaaagttaactcttttaaggtaagatgttccaaagagggcaatttcagtctgtctcttccagcatgcatgcataattgagagaacatatcagatatactatgataaatgtttgtaattatgtgactttttcgaggttttcaaagtatatattctgtcatttgatttccaccacttatccccattaaaaccttgtgagtttagagaggcagattcagaaagtttaaccatcaaaaggtaaatgacttggccaagatctcatatccagtgagggacgagagctaggatttgaacgtaagtcctttgatatctagtcaactgccacatccactgtgtcacactgccttctcagtcctgtaaacaaggtatgtaatagtacatttgggatcttagcattggaaatgataaaataagtgactgattcagtttccatatgaagaaagtatgttttacaacctgaaaactctgtataattagttttcttcaatatagaatgtttagccatattaactgcattaagatgtgtcatatatgaccaagcacagtatgcaaaatggaatttgggacacatgcactgttccccaatttatttgaaattccattatgtaaagcatcaaaagggccactgatcagaataagggaagaggacctgaggccctgcctcccctaaaacacctgcttaggcccctctgttaaattttagtgccctggagagctccatttggaaaccattgctgtagcctattagagcagttttctttgtgaacaagttacgtttttttcttattttttttctttttgtagcatgtaggaaatgctaaaaatacaaaagtttgttcactttcaggaagaaattttaagcttctgtcctttccatgccttttaaagccagaaaaatgctggattaaagagcatgctagatattaataattttggacagttggaaaacagaactaactggtggttttatactatttcctgctttatgacataattgcagccaggatacttgtgtctgagacattataacatcacaccatccatcctactattggatgcaaaaccattaatacaagtgtttttctagatgaagggattacaccttgaaagaatttgctaatagagagggtttatggaaagtaaggtaattgttgagacactactatttttgctgcatctattcatcttgtgtcttttttaaaaaccagtattacattaaaagaatatttgtattccattgatatcagtttgtaaataaaaacattctttctaaagcatctcaaatctaaagcccatgttcattctaaataaaatcgtatgtgatcattagagacagaaatggaagtcccttctaaattcaggtagtagtacttgcattttccctacttaaatattcccataaagttttatttatagtatttggtaatgaggtcatgaatgtcataattttttttcgatatgtgaaaaatcaaaatgttaataaatcattgattttgagacatctaatgatatttctaaaaatatctagttaggatatggaatttagattacattttaattgtcttccagaaagcactagtaatctttcaacatagatttatttagcacctgtggttacggataagacagtataggagatgaccctaataatctctaacctttatggagcacttttgatatgtcagttctgtttaaaaaacaatacaaaaacaaactctttatatatattaactcctttagtcctctgaacaatcttatgaggtagataatatgttacagatggagaaactgaagcacagagaagttatacaacttgcccaagtttgcacagcgtaactgggattccagtagtctggttccacagctgtgagcccttaaaaattaagtatgaagatgataagagagtccctttgtcctccaggtaacttacatgcagtcttgtgaaacaaagttaaacttcatgccacccaaatgaggtacacaagtaaataccttctttttggcaaaaatcttctgtaaacttttctccacagttagttaattaggattttaaaacttccttctgtgtccctgtaacaataattattgaggaaaaaactaattatattaacagatattgataagtaactttcctgaagtgatgccgcatgataaaagtaattattgtgggattcttaattcatgaaatactttggatcagtatttctcagaatatcttaattttcatatgaaaactaatctgtaggaaaagtcgttgaattattgtattagccgtttttgtaggtaattttcaccagtgtgctcatttgctaatatttaatttttacatatcttctcaacttaaatgtcactattttaaatagtaagttgaactttgaagcataaaaatgtatactttcccaaagaggattttggtttatggggtagttttgtctttgtgtaaatattcgtgtgtatacattgtatgtgtgtagatgttttttcctctttagaggataactgataattcttaagaatcagatttaaatgataattttaatgcaattttaatgtaaaaattctataccattttattactaagatctccaaaacaaatggaatttactgtaattaatattgacttatcactccacctgttttaagaggtatgattttttttgtgtacctcttttagaagagtagtatttcatatcaaaatacatctgtatataactcatgctcagatgcttgatttgctctcattgtggccgcattctgatttttctagcatggggtagggagtggggaagcgggggtgtctgattggcagttctgtcttgtggtctggcatggccctgtttgtagtgctgattgcaggggttgacttgctacagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgttttattttaactctgtaaggctttaaatctcttccatagagattgcaataaatcattactatacttttgattgtgaactcctcaccttacattacaagtgacccagaataaatataaaatgttgacggaaaaatagaaattactgaattttgttaaacctatgaaacacaacttgcagtgcaacctctgaattactttgctaaatcttctccagtgatcttttactccatctttctcatcatgctgacttgtctctcctctgtctgttcagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtaggacatatcccatttatcagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 173816 - DNA, 3665 bp, Homo sapiens
  Payload ID: 14130
  Gene Symbol: REPS1
  Gene Name: RALBP1 associated Eps domain containing 1
  ENST ID: ENST00000626459
  CDS Start-End: 580-1242
ccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcagggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttttctggagggtagattgtgtttgttggcacacccaccttttctgttccctagcatctgggatatgcaatgcttctatggctaataccacacaccaatttaatttatagaatgggctcctcatttacatctcagtcacagactcagaaataaattgtcagtttgtccttttatgtttaatattttacataaagcatctattctataaaaatctttagaaagagtttcccatttaattttgattttaaagaattatattggataaggtggttttcaccataagctaatttactctctgcagccgtctacattcttcacaaatcatgtggtacattgaagcctcttttacatgtcaacttgtgacaaatacaaacatgtgagattttatattttccttgtggaaatgtgatcaacttcatcagcgacttcgaactattttatgagattcaataattcagcagtcatgtaaacttatgaaataggtatgagtaatggcctttcttaatttttttaagtattgttttaaaacttctgaggatatcagttattcccagaataaagggaaattccttaggatttctagtttacctttagccatcttgtcactcattcttttgctatacagacaagtttttcctattaatgagtttctggagtatgccttattcaggacaatatgctgttttagattttgtttaatattaaatgatatatacatttcgatccattgctaacagcagatattccctttaagatttattctgtctataggatcatagattttaaactgcatggatatatcttggcagaatcagaagtgtggttttacaccaataaaacagcataatatttt

SEQ ID NO: 173817 - DNA, 7771 bp, Homo sapiens
  Payload ID: 14131
  Gene Symbol: REPS2
  Gene Name: RALBP1 associated Eps domain containing 2
  Uniprot ID: Q8NFH8
  ENST ID: ENST00000303843
  CDS Start-End: 1-1980
atggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaa

SEQ ID NO: 173818 - DNA, 7953 bp, Homo sapiens
  Payload ID: 14131
  Gene Symbol: REPS2
  Gene Name: RALBP1 associated Eps domain containing 2
  Uniprot ID: Q8NFH8
  ENST ID: ENST00000357277
  CDS Start-End: 172-2154
ccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccagatcacagaactgtgtggtgcaaagcgggttggttattttggtccaacacagttttacattgccctgaaattaattgctgcagcacaatctggcctcccggtacggatagagagtattaaatgtgaattgcctctgcctcgctttatgatgtcaaagaatgatggtgagatacgatttgggaacccagctgagctgcatggaactaaggttcagattccatatttaactacagaaaaaaattccttcaaaagaatggacgatgaggataaacagcaggaaacacagtctcccacgatgtcacccctcgcctcccctccttcttccccgcctcattaccagagggtgcccttgagccatggctacagcaaactgcggagcagcgcagaacagatgcatccagcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgcacttcacttgtatgttttactgtggtggaaaaaatacttcaactgattatcacacttgaaatgctaattatcagtggaatttgtctcctattcttaagtacttctgcaaggtattagatgctgctccttaccaaaaatcagtcttctagcaaataaaaataacttagagcattatttatttaaagaatttatgttttctataaaaccttataaccaagaaccttcaggatgcttgtaaccaagtactttcaggatgctttttgtatgtatatcacatagagtaggttggtttcctgagtaattgggattccaactagatagtcattggtgtgaccataataaaaacaaaagctaaaataaaagcatcagatttagactggcgctgtgccctctaccactatatgccaaaaattgcttctctagtgccattttgatattatatctagctataaataatacatgactatcgttttctattgaatgtcaaagacttactgggtctttacacctctgtaaagtggaggttttggcaatgagctgtttaacttggccaagctaggctgtcaacccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccacccatcaaatatgaaaggctgatgagactgttaggattgataaacatttgttgtttgaacccagctatccaaactggggaagaaggggaaatggttgttaccaacaatctctagtagttattttaatctttattttaacctggattgcaaatgtatggggtatgaggagataatgaaagaaaagtggtcctcatgctggatatgtgactgttttgttctctgtaaagtgtattcttgggaagtgattggtttatatcagattcagaggagcccaattaactccagtgtaggtaatgtaaaacagtaagctcaaattgcagaagccagtatcctacagaaatttaagtagctactgcttctcctgaaagcccaagttgaaaatgggaccacaggggcacagggctactgaccctcacagggcatgccagcgttaacaccactttgagagaccaatggcaagaaatgctgtctcttgtgcattttactaatttccccattcttagggtagcagggtgggggtgtatagggtctttttgaagcagttttggataggtttgcaatatgtgggattcagcctttgatttcaatagagctgagagcttttagaacaagcaggcatttatttaatgtttccttagtccattggcaagctttatcaatagcttaatggcagaggataaaggctcaaacagatgatgttttttccacagaaaaacaaattgttgaatctattccgtgcatatttaaggattttgaattgattttgaaaatcatgaaacttgaactatttttctattccctttttttcttccccatttgctgccttttttgtttttgtgggggaagggttgggagtaagtttaaactcttccgaagattatgaatgggtcagcacaaatttttaggcaactgctttttccatgttctgagatctacgggctacaacaaattttatcagcagtgttttttgtttttttgagatggagacttgctctgtcgcccaggctggagcgcagtggcgcaatctcggctcactgcaacctccacctcctgggttcaagcaattcttgtgcctcagcctcccgagtagctgggattacaggcacccaccaccacgctcagctaatttttgtatttttagtagagatgggattttgtcatgttggctaggctagtctcgaattcctgacctcaagtgatccacccgccttggcctctcgaagtgctgggattacaggcgtgagccacccgcccggctatcagcactgttctgattgcagacgtttcacagcatgtttggcttttggtaaattcaatccaggaaagactagcatgtgcactttatctcataatcttccagtacatatgctctcagttgggatagcagttcatttccattaggcagacgtataaactaaggaatgttagtctgcagtattcattttaaaaatattgacatgcttttcccctcccctccatgaagtcagtgccagagtgagccagattgggaggttggggttttgtttggttggcttggttttcattaagggaaaaaacttgcattggacaatcaaattcccctgagtttcataatctcatcaatattttaagataggcgagcacacactaataatatctatgcctaccttcttgggtggactcaactgtaaccacagtttattagttgcttagaagtggatttttaaaaaacagttaaatgtgtgtgcataacacacaagtaatgacacactactattattattacctaagtagtgctcatcctctctttctgtgttttcttaggatgtgcactttaatttaggattgtaacgcctaataatatttctgtgagcctttaatgtgatttataagatggccgaattactgaaatcaccattatacctcttccataaaacgactccaaagttagacctgcctgttggggagaattctatagacagaaggtcaatgttgtccccatccataggggttgaattaccttgctgttaagtggtcttcccccattgggatcctacagtcccacagatgaaagcacagtagtagctgacagctggcttatttggtccctcggcatctctcgtatgtggcatattgcttttgccactttcctatccagcagacatcaaagcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaagtgtgggt

SEQ ID NO: 173819 - DNA, 1789 bp, Homo sapiens
  Payload ID: 14132
  Gene Symbol: RALY
  Gene Name: RALY heterogeneous nuclear ribonucleoprotein
  Uniprot ID: Q9UKM9
  ENST ID: ENST00000246194
  CDS Start-End: 503-1423
ggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctga

SEQ ID NO: 173820 - DNA, 786 bp, Homo sapiens
  Payload ID: 14132
  Gene Symbol: RALY
  Gene Name: RALY heterogeneous nuclear ribonucleoprotein
  ENST ID: ENST00000333552
  CDS Start-End: 272-786
cggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaatggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtgg

SEQ ID NO: 173821 - DNA, 6430 bp, Homo sapiens
  Payload ID: 14132
  Gene Symbol: RALY
  Gene Name: RALY heterogeneous nuclear ribonucleoprotein
  Uniprot ID: Q9UKM9
  ENST ID: ENST00000375114
  CDS Start-End: 579-1451
tctggacctttccaaagccaggctgagagggtggggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggaacacagccaggacacagacgcggatgatggggccttgcagtaagcagcctgacaggagcaatggccaccagcaggtgaagggcatcgctgccccaggcctcaagccgggcacccaaccctggatgccaccccccagcgggtaccagaggaaagctggcagcaggcgcctcctcccccaacgcatcccagccagtgccatgtcctctgcaggtggagttactggcctactccttccccatgagccctccctgtctgcactgcccaggccagagggtagagcacaggggtttccccatactacctcccctccccaggacactcccaggcttgggttttttctataggtttggcggggggccacagggaggggaccctgacaataaagagattggatcccaacctgttctgagatgggatggtttgtgttttctcatgaagatatcccggcccctctgccaaccaaaaagctggtctagggtgcctaatactgatccatctggaccttagtgtcctcagtggtgattaaaatggccagtggggccactggggagggttggatatgctggcccatgagcatcttgctggctgaagtgtcaagcagttgtgacccacttggtttaccccatagtaggtcaagaccttatctctttccccagcttctaagtctggtctttcccagctcttaaaaggattctagagtctgccagtctctaccttctctcttctggcttaggacactataattttttcatttggacgttgtcctcccaccagcctcccagtcttctgcctctgccctgtaccatctcccagcagccacgcagtctttctgaaacgtatcccttccctgcctaaaatccctttactgactcttcatcatcaggacaaaaccctacctcctgaatgtagggtgtaagatcctgcttactccagcctctcctgtttcttgtcaccacccctttcctgcccctgacacaaaccctacatctcagtctcacaaaacacacaagttcttcacactccgggcaggtttggtagcaaggaatagagcgtactccagtgacagcaatcagtaggaagtttgcatccggagacacgcagcctgtctgcccctgtcttgggccacccgtctagacatttgttctctaacaatcagccgggttccttcaaacgtgtgctgcttatacatgctcattgtgtactgctaatgtcacctacttcccccttcattccccacaatgaatggatccattttccccatgttcaagttcccaagagagaatcgactgccactgtaattttttttcctaatcactcataggttacaagtacctaccctggtccagtgaactgcgggattcatatgtggccacttaggctggtctcgttggtatggagctgtgggagggcagcacccagaaataggctttgttccaggcctggcacgtactcctcctgctcctactttctctacctgggaaatagccgctcaggacgaagctgctgctgtggtgtcgccacctctgagaagtctcccagaccctccgactgctctttaattgcctgttctctcctctggaagccttcccccaacacagaaaaattcaatcccatcatcaaaaagggctttaggttttccctccatctttacgtgttgatcaaagtttgcagatctgctggaatccttattgaaaactccccatttcaaaccaacccggtctacagcctccagggaagcttcctcctgggctttggctccatgttttggtagagggtggaggctttgggcagtgctcaaactccaccgggaagtctctctcactgagcagccctcctgcctgtcatcctgggcaggcgagcactctgaggccccagtgtagctctgtgctttgatattcccaagctctgctggggcctgactaggccagccccaaggtggccagagttctggcttcatacctgagccaaaagccccaatccatgcttggccattgcctgagtattagctgccccagggggatcacggtccccatatatttgcttgccatggaccctgggcagcagggagagagtagagatttgtcaagagcccatggtggaggctgaggccctgaggccatgagatgcaggcatggggtgagaaacaggccccttggaattgggctgggccttggcccagcttagtcaaatcaaaaggcttctatttggagagctgaagagggtgtacagaggaaggggctaggtctgcaaggagtgcctcatctccctgaagagctctcagtggaacatacttcacccatccatgtacccacatctttccttgcccagaaggcgagagccagctataacagacccatttcaataccctggcaagtcattactgcccttagctcttggtgtccccatctgtgaaacatgggggacagctgctagcctggattggaacttgggcaaagtccaaagaatgggatttagagctgaatgaacctcacactgagggcacaatagcactaggcactgcccccagagcctagtgctatatgcctgctgcaggtcctacccaagcatgctttactgaggaactcaacgtttcagagcttgagggtcaggttgatcatgggcttgtgaccataggcttccttagtatgccaggcttggagaaccgtgagaaaagcagggaagataccttcaagggtagcaggcatcagctctactcaccttggcccataaggctttgcctggtcatgctggcaccgggtcatatgctggacagggagaacgagagtcccatcctggaactccagaaaagcccctggatgctccagcccctgggaaagcacacagccaggcccttgggtgggaggttggcttctaacagtgcatacacatgcccttcctctgagtcggggcagcaaaaacatccattccgctgcgcaacagttgtcatttttctaacatctgaaaactccagaaggagatggtgataaatgtggtaccggattctgcctaaaggatcagtctttagatgttttcagattgaaagcctcatttgtgatcctcacagccatcttgaaagaatagagcagccagtgggtatactggattgtgagctaagaggcctgggactttccccctgttgctgccagccaggttgatgaccctgggcaagtctttttccttaccaggtctcagtttcctcagctgtaaaatgagaggttgatctggatcagggatagtaaatgggcctttgttcagttactgactgttgtataacaaaccacccccaaatttagtagccttaataaacatttattagctcctgagtgagtggcttggcagtttgggctgtgttcagtgtggtggttcttatctcatctgggccctcgtgtggctgaagtgagctggcagatcagctggggactggctggtctcagatggcctcgcccgcctgtcaggtggttggctgggcaactgggccacacgttccagcatctagcaggctgacccaggattctagacatcatggctgagttccaaaaaccgcaagagaagacaagcccagtatgcgagtgctcttgaggatattgctatgacgtatcttttggccaaagtaagtcacatggctaagcccaaattcttcttaacaggaggagcttcaaaatatggccatatttaaaaaatctacctcaggactcatttcacttgccaactcagaacttttagtagcagctgcctggagtgccttttgaggatctgcagcaattttcagactgtttggaaatactgacatgatagtttggcagtttctcttatgagcatggaattcaagtgtgggcacgtgagcgtcaggtatttgccatccctggccaggttgacccgtaaggtcataacctgccccataggatgttatatgcagtaggcctgtctgacaagaccacagaaatagagaaggcaaagcagagcaaaagattctgagccaggcatccttggttttcatcccaaccagatcattgattgattgaggttttaggcaaatcaaaatccctccaccagtagccagattcttcataataaacttcctccataacagtaaaccatttcctgaacacctgctgttaaaaagcacattttacatttacttaatctccacaaccaccctcagtaggtgtagtaaggacttctggttacaagttacagaaactgaattcagtcctgcttagtgggaggaagtttattggctcacaaattgtaaagtccagggatcttcagacatggggacttgggttcaaaagctgccatcgagaatccggttagccaggcatggtgacacgtgcctgtagtccccgctacttgggggactacagtgggagatcatttgcacctaggaggttaatgctgcggtgagccatgatcctgccgctgcactccagcctgggtgacaaagcgagaccccaactcaaggggaaaaaatctggttttcgggcaggttccaagaagtggtagagcatggccatagggcctgtgagaatagagggacagaggggagaatccccaaaaggagagcaaggcttggctaacaaaaacaggcatccactgtgtggttatgtctattctatagattttgtagatgaggtttaaaagcatggccccaagtaaaggtggcatctctatcctatcctcgcctttatctaaactctgtgaccgatcaatagcatatgatggtggtggtgctctgccagtctcccagtcccagactgaagcactagcagcttccacttattatctcttgggactctagctcttgggacccaaccaccatgctgtgaagcagcccaggccacacagagaggccacgtgtacatgttcagctgacagcagtatcaaatgtcagacatgagagaggaaggcttcaagatgactccagcccagccaccgtctgagaacaaagtaagaactgcctcactgatgccattcaaagcccagcaccatgagagataataaaacgttgtttgaagatgctaa

SEQ ID NO: 173822 - DNA, 766 bp, Homo sapiens
  Payload ID: 14132
  Gene Symbol: RALY
  Gene Name: RALY heterogeneous nuclear ribonucleoprotein
  ENST ID: ENST00000413297
  CDS Start-End: 499-766
gcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactgtcttcatttccctatttgtaaagttggagtgcctccctgtcccctcacgtctcatgtgtgtactcctaccatgcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatgg

SEQ ID NO: 173823 - DNA, 1204 bp, Homo sapiens
  Payload ID: 14132
  Gene Symbol: RALY
  Gene Name: RALY heterogeneous nuclear ribonucleoprotein
  ENST ID: ENST00000448364
  CDS Start-End: 662-1204
ggagagcccatgcgcctgggaagccgggctgtttctgggcggggctgcagactcctcgtgctcgtgtcaccgtgtccttcccaggagacagagaaggaggagagcccggaaccagggccggagcggcgggcggagccgagctgcggggagccgctccgggtgcccccacccccgcgcgcctcagtggtgccggccgagggcagggctcgcggttgcggggctcgcgccgctgtcagtgcggcggggcgcgcgagcggcgccagctcggggcagcggaacccagagaagctgagggggcggtagcggcggcgacggcgacgacgacgactcccgcgcgtgtgcccagcctcttcccgccgcagccgcccttttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggttcccagagagggggcttcttgaaaagcaagtagagcagaagactggtgagcacggtgtttcccagcatctccacagtgccagcacagaggaggacactcaagaaatgtttgttaagtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacagtggctacatctttgactatgattactaccgggacgacttctacgacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaag

SEQ ID NO: 173824 - DNA, 871 bp, Homo sapiens
  Payload ID: 14132
  Gene Symbol: RALY
  Gene Name: RALY heterogeneous nuclear ribonucleoprotein
  ENST ID: ENST00000442805
  CDS Start-End: 160-871
gcaactttcattccctctgaaataaaacagtgcttaggccagtacctagtctgtttccaactgtgcggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctggacatcaacatggctggagagcctaagcctgacagacccaaggggctaaagagagcagcatctgccatatacaggctcttcgactaccggggccgtctgtcgcccgtgccagtgcccagggcggtccctgtgaagcgaccccgggtcacagtccctttggtccggcgtgtcaaaactaacgtacctgtcaagctctttgcccgctccacagctgtcaccaccagctcagccaagatcaagttaaagagcagtgagctgcaggccatcaagacggagctgacacagatcaagtccaatatcgatgccctgctgagccgcttggagcagatcgctgcggagcaaaaggccaatccagatggcaagaagaagggtgatggaggtggcgccggcggcggcggcggtggtggtggcagcggtggcggtggcagtggtggtggcggtggcggtggcagcagcc

SEQ ID NO: 173825 - DNA, 595 bp, Homo sapiens
  Payload ID: 14133
  Gene Symbol: RALYL
  Gene Name: RALY RNA binding protein-like
  ENST ID: ENST00000522613
  CDS Start-End: 340-595
agatctagggaggagggaacagcagaggcaaaggcagcttgggagggatgggaaatggaaaatcagggaaacaaacaaacaaacaaacaaaatgaatgagtgaatgtgggcttgaatagtaaaacttccagagagaagacgatgggatctctccccaggtaactacctgtagatgaaaaatagatgaaatacacaaggaagtggcaagcaacaactttgagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttg

SEQ ID NO: 173826 - DNA, 1457 bp, Homo sapiens
  Payload ID: 14133
  Gene Symbol: RALYL
  Gene Name: RALY RNA binding protein-like
  ENST ID: ENST00000521376
  CDS Start-End: 89-529
cagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttgggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaaa

SEQ ID NO: 173827 - DNA, 1924 bp, Homo sapiens
  Payload ID: 14133
  Gene Symbol: RALYL
  Gene Name: RALY RNA binding protein-like
  Uniprot ID: Q86SE5
  ENST ID: ENST00000521695
  CDS Start-End: 329-1204
acagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 173828 - DNA, 571 bp, Homo sapiens
  Payload ID: 14133
  Gene Symbol: RALYL
  Gene Name: RALY RNA binding protein-like
  ENST ID: ENST00000517988
  CDS Start-End: 256-511
aaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcagatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccc

SEQ ID NO: 173829 - DNA, 1684 bp, Homo sapiens
  Payload ID: 14133
  Gene Symbol: RALYL
  Gene Name: RALY RNA binding protein-like
  Uniprot ID: Q86SE5
  ENST ID: ENST00000523850
  CDS Start-End: 98-754
agtgagcaacagtcttactgcaaagcaggagcacaacccgtctctttgtctccgtggtcaaatcaattacttcttagaaagtctaatttttttcaaaatgaccatgtacaagagcaaacgcagacatcagagatatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaac

SEQ ID NO: 173830 - DNA, 459 bp, Homo sapiens
  Payload ID: 14133
  Gene Symbol: RALYL
  Gene Name: RALY RNA binding protein-like
  ENST ID: ENST00000522647
  CDS Start-End: 317-459
agagccttgaggatggcaccggccctcgcacgctcaactcctgctcctcctcttcgcaatgagtaaacgacgcagtaggtcctacccagcctattttgctttaccaaagggctttgctttcttagggatgctgtctttggatcttttttttccctgttgtgttgcgttggttttaagtgcctgctggtgtcgtcttccaggggatggggaaatagtttcttataagatgatcacttgggtttaatgttgaggacgacgctgttagtttgcagtaatgaccctacacctctaaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaat

SEQ ID NO: 173831 - DNA, 2682 bp, Homo sapiens
  Payload ID: 14133
  Gene Symbol: RALYL
  Gene Name: RALY RNA binding protein-like
  ENST ID: ENST00000518566
  CDS Start-End: 915-1757
tttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 173832 - DNA, 1972 bp, Homo sapiens
  Payload ID: 14133
  Gene Symbol: RALYL
  Gene Name: RALY RNA binding protein-like
  Uniprot ID: Q86SE5
  ENST ID: ENST00000517638
  CDS Start-End: 125-1039
ggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttcttttaaaacaaa

SEQ ID NO: 173833 - DNA, 2701 bp, Homo sapiens
  Payload ID: 14133
  Gene Symbol: RALYL
  Gene Name: RALY RNA binding protein-like
  Uniprot ID: Q86SE5
  ENST ID: ENST00000521268
  CDS Start-End: 1106-1981
cgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggtgagtaccttctcagtggcattcttgtcctattcttttttttgtccttttttttggttttttgttttttttgtttttgttttttttctttttttccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatggaaaaagcgatgtgaagtatggtgcctatttttttcctttgtaaaaataaaaagcatgtttctaactctttttttgcatactctttttctgataacatttttgtataggtgggattttacggcagtgtttacaagtttgtggtcttgcaatactggtgcaaaccactgagcaaagacattaattttatattttttgtgccctttttggaagccggtgaaaacaaattcgttttttttccctcctgtttttgatacccattgataacatgaaacttttcttacagctggtgattgggatcatttttaagcaaaatacttttttcctcctttaaattaactatgacttttgcacatttgacttttttaaaaaaccgagataattttatgatagatatcctgatatctatatctatattgtcccttatttctcccccttccctccccgtaaatcaattttcaaatgatggcagtggaaggtttttctggaaaaaaaaaaatgaagtgcggtttggtttccttgtcaacggaggatgaagtgaacagctgagcagctcgcagagagcaggattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactg

SEQ ID NO: 173834 - DNA, 2168 bp, Homo sapiens
  Payload ID: 14133
  Gene Symbol: RALYL
  Gene Name: RALY RNA binding protein-like
  Uniprot ID: Q86SE5
  ENST ID: ENST00000522455
  CDS Start-End: 368-1243
tgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcgatatagcccttggcgaggtgcctggctccatagattaaagcaaggagagccaatcatgactggcaaaacacagaccagcaacgtcaccaataagaatgaccccaagtccatcaactcccgtgttttcatcggcaatctaaatacggcaattgtcaagaaagttgacattgaagccattttttcaaagtatggaaaaatagttggatgttccgttcacaaaggttatgcatttgtacagtacatgagtgagcgacatgcaagagctgcagtggctggagaaaatgccagagtcatcgccggccaaccacttgatatcaacatggcaggagagcccaaaccatacagaccaaaacctggaaacaagaggcccctttctgcactttacagacttgaatcaaaggaacctttcctgtctgttggcggttatgtctttgactatgattactacagagatgatttctacaatcggttatttgattaccacgggcgtgtgcctccacctccccgtgcagtaattccgctgaagcgtcccagagtggcagtcacaacgactcgcagggggaaaggagtcttttccatgaaaggtggatcgagatctactgccagtgggtcaacaggttctaaattgaaatcagatgagttacagaccatcaagaaagaattaacccagatcaaaactaaaattgactccttgctagggcgcctggagaagattgagaaacagcagaaggcggaggcagaagctcagaagaagcaattggaagagagtctagtgctgatccaagaggaatgtgtgtcagagattgcagatcactctacagaggagcctgctgaaggagggccagatgccgatggagaagagatgacagatgggatagaggaggacttcgatgaagatgggggtcatgagctgtttctacagataaagtgatctgaaataacgcatgatgccacaaagcagaaaagagaaactgtgacaacccccagaaatgtgaaaggaggtttcttactggacagcagcatctttggttcaatttatataaaaacccaaataaataaaatggacagtattgctcagttttagaaattccatttcttctatgttttaagctgtacaattgtcaggtttttatggtttaaattgtaaatgtgttttcccctttgctaattatgttttttttttcagtcttaaaatgtgaaaggcatttatgaatggtaagggaaacactatatacaaatgtatatttgtaaaagctatttttatgattagcatgtttcactgttgatcatatataaagtcaggtgatattgcaattctgtatttaaagcttatttccaacaatgtcatgtaagaaaagatgcatcttatgctagtttttataatttatttataatttatagtttaaagtacttcagatcataatgataaaatacttgaaaaagttatatttctgccctgtataagcaccctttttattaataaagaatgcagatatttcagatgtgatataatagttaaagaactgttggtttgatctgtgattaagttgagcatgctccgctctactgaactaaatgatccaattattacttcagtctgggtatgagattccatggacaagtaaggactagattgccaaggaaaagactgtcttgcccttggatccaaaagtttaaattagtgcatacatcatgtcatttcacctcctgttcctaggaactctccattcccaagcattgccagtgttttccagataatcttagctgttgtcttgtgctgtggaaatggaagaaaccatcttcacagaccgtaggagaattcaacatataatttcttaataaatactgtttctttt

SEQ ID NO: 173835 - DNA, 837 bp, Homo sapiens
  Payload ID: 14134
  Gene Symbol: RANBP1
  Gene Name: RAN binding protein 1
  Uniprot ID: P43487
  ENST ID: ENST00000331821
  CDS Start-End: 103-708
gccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 173836 - DNA, 1132 bp, Homo sapiens
  Payload ID: 14134
  Gene Symbol: RANBP1
  Gene Name: RAN binding protein 1
  Uniprot ID: P43487
  ENST ID: ENST00000402752
  CDS Start-End: 227-829
gagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctggg

SEQ ID NO: 173837 - DNA, 1879 bp, Homo sapiens
  Payload ID: 14134
  Gene Symbol: RANBP1
  Gene Name: RAN binding protein 1
  ENST ID: ENST00000435265
  CDS Start-End: 248-469
agatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacaacgtgcctctgaactcagagcaggcccgcagcgaagcttagagcacacgggggtgtggagtcagccagacgggccctgatgggaggacgcagcgcccaggctgggctcgggacgaggatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactc

SEQ ID NO: 173838 - DNA, 584 bp, Homo sapiens
  Payload ID: 14134
  Gene Symbol: RANBP1
  Gene Name: RAN binding protein 1
  ENST ID: ENST00000411892
  CDS Start-End: 94-584
agacgcggagggaaggagctacgagtagccgccgagaggccgcggagccagcgacgaccgacccagccgagccgccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggca

SEQ ID NO: 173839 - DNA, 333 bp, Homo sapiens
  Payload ID: 14134
  Gene Symbol: RANBP1
  Gene Name: RAN binding protein 1
  ENST ID: ENST00000421656
  CDS Start-End: 174-333
gaggcctgggggctgcagggcccccgcgtgaccttggggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactaca

SEQ ID NO: 173840 - DNA, 1389 bp, Homo sapiens
  Payload ID: 14134
  Gene Symbol: RANBP1
  Gene Name: RAN binding protein 1
  ENST ID: ENST00000430524
  CDS Start-End: 248-1084
agatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggcc

SEQ ID NO: 173841 - DNA, 645 bp, Homo sapiens
  Payload ID: 14134
  Gene Symbol: RANBP1
  Gene Name: RAN binding protein 1
  ENST ID: ENST00000416427
  CDS Start-End: 486-645
tctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactaca

SEQ ID NO: 173842 - DNA, 832 bp, Homo sapiens
  Payload ID: 14134
  Gene Symbol: RANBP1
  Gene Name: RAN binding protein 1
  ENST ID: ENST00000423859
  CDS Start-End: 219-832
gccacgcgggacggccccagcctccaggaactggtgcgggcggcgggtttcctccggctcggcccacttggggctccccactagacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgct

SEQ ID NO: 173843 - DNA, 744 bp, Homo sapiens
  Payload ID: 14134
  Gene Symbol: RANBP1
  Gene Name: RAN binding protein 1
  ENST ID: ENST00000432879
  CDS Start-End: 248-744
agatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcct

SEQ ID NO: 173844 - DNA, 932 bp, Homo sapiens
  Payload ID: 14134
  Gene Symbol: RANBP1
  Gene Name: RAN binding protein 1
  ENST ID: ENST00000418705
  CDS Start-End: 497-932
gcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggatcaggcaaaaatgatcatgccgaaaaagtggcggaaaagctagaagctctctcggtgaaggaggagaccaaggaggatg

SEQ ID NO: 173845 - DNA, 5341 bp, Homo sapiens
  Payload ID: 14135
  Gene Symbol: RANBP10
  Gene Name: RAN binding protein 10
  Uniprot ID: Q6VN20
  ENST ID: ENST00000317506
  CDS Start-End: 117-1979
ggactcggactcggtttccctgcggcccagggaggctcacgggccattggctgagcggggcggatctggtcccgctcctccccgcccccagtgacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtca

SEQ ID NO: 173846 - DNA, 2232 bp, Homo sapiens
  Payload ID: 14135
  Gene Symbol: RANBP10
  Gene Name: RAN binding protein 10
  Uniprot ID: Q6VN20
  ENST ID: ENST00000448631
  CDS Start-End: 25-1809
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagt

SEQ ID NO: 173847 - DNA, 577 bp, Homo sapiens
  Payload ID: 14135
  Gene Symbol: RANBP10
  Gene Name: RAN binding protein 10
  ENST ID: ENST00000602815
  CDS Start-End: 25-273
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagccctt

SEQ ID NO: 173848 - DNA, 2374 bp, Homo sapiens
  Payload ID: 14135
  Gene Symbol: RANBP10
  Gene Name: RAN binding protein 10
  ENST ID: ENST00000602677
  CDS Start-End: 25-1977
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagtt

SEQ ID NO: 173849 - DNA, 2756 bp, Homo sapiens
  Payload ID: 14135
  Gene Symbol: RANBP10
  Gene Name: RAN binding protein 10
  ENST ID: ENST00000602506
  CDS Start-End: 22-471
acaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctgatcccacttccagaaacctgagttctttgctccaggtccaacagaggtgaacccacttgccccagactggggttattttcctgcaaaaaccggatcctcgtgtgttccccatctctgctgacagccactgtccaccttggcccccaggactaagtgtcattgaatccactcctgactcacatttggtcatatggggaaatagacatcaagggctgtggtcagctggtggagcagagcatggattctggagctataccacctgcatttgcatcctggcggctgtgttacctggacctgggacccatgttacagctgacagtccctgcagtgtccaccattaacaccacctctctctggagcatctttcaccttgggatctacagtacttcacaggggtctgctgtggggcagccaggtccctctgtgagggaagccatgcttcttccgagctgggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcat

SEQ ID NO: 173850 - DNA, 1248 bp, Homo sapiens
  Payload ID: 14135
  Gene Symbol: RANBP10
  Gene Name: RAN binding protein 10
  ENST ID: ENST00000602638
  CDS Start-End: 25-405
gacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatgggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaagtaaggtttattctactttcccctttcccttcctcacctgtccctaactctgctctctggctcatgtcaaccctggttaacctgtcaggagtccattcagctctggtcctcatgaccagcttgcagctcgaggccatgttcctgtcccaccttcaagatggcactgcccagatggacagttggcaggatggagacgtctcagggcagcctccctaatgcacattctgaaggctgggcgcaggccaggccctggcatggctggttccattcctccatttcctccctgcttgtttccttccccctgaatcctggattcctctcaacctcctgttcatggtcttccaggaaggctgtttgcctgccttagtagttctgcttattcctagcc

SEQ ID NO: 173851 - DNA, 5305 bp, Homo sapiens
  Payload ID: 14135
  Gene Symbol: RANBP10
  Gene Name: RAN binding protein 10
  ENST ID: ENST00000630626
  CDS Start-End: 117-1979
ggactcggactcggtttccctgcggcccagggaggctcacgggccattggctgagcggggcggatctggtcccgctcctccccgcccccagtgacacaatagtagctccctccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtccactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtgtgtgcataagggaccttggagccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacaga

SEQ ID NO: 173852 - DNA, 3653 bp, Homo sapiens
  Payload ID: 14136
  Gene Symbol: RANBP17
  Gene Name: RAN binding protein 17
  Uniprot ID: Q9H2T7
  ENST ID: ENST00000389118
  CDS Start-End: 103-1833
gaccccgcgggcgtctggggcttccgcggcgcccgcctctgctccctcccctcgggcgctgggtgccgaccggccggctggccggcgccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcaggtggagtttcaccatgtttcccaggctggtctcgaactcctgaactcaagcaatctgcccaccttggcctccaaagtgctgggattacagacgtgagccacgcgcccagcctgaggccatgttcctaaagctctgaatttatccacagcttcagtatgtttctaagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctga

SEQ ID NO: 173853 - DNA, 4588 bp, Homo sapiens
  Payload ID: 14136
  Gene Symbol: RANBP17
  Gene Name: RAN binding protein 17
  Uniprot ID: Q9H2T7
  ENST ID: ENST00000523189
  CDS Start-End: 165-3431
ctccagcgcttcgaatgcggacgcgaagcctggctgaggctgcgaaggacgagcggcgcagggaccccgcgggcgtctggggcttccgcggcgcccgcctctgctccctcccctcgggcgctgggtgccgaccggccggctggccggcgccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 173854 - DNA, 296 bp, Homo sapiens
  Payload ID: 14136
  Gene Symbol: RANBP17
  Gene Name: RAN binding protein 17
  ENST ID: ENST00000518492
  CDS Start-End: 1-143
tatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggatgcacctaaactattgatgattaatcaccttattaaatgattccattctgtgta

SEQ ID NO: 173855 - DNA, 3375 bp, Homo sapiens
  Payload ID: 14136
  Gene Symbol: RANBP17
  Gene Name: RAN binding protein 17
  Uniprot ID: Q9H2T7
  ENST ID: ENST00000519256
  CDS Start-End: 17-1747
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggccttgcgtggctccccagcgccagtatcccttgctttactgaatagatgtgtttaagcaagttggctttgaaacaagtttctcctatgtgaattgcattttctggttgacacccattacaaaattggaaatgcatttccatggaaaatctcctatgcccagttgtacgcctgaggagtgatgtacccagagttccagagaaggcttggaaaatagttaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttggtaaggatcatagaggacattgtttccataggaaaaacttgattatgggcttttaatgtatgtgattattgagactatcatcctacaaagggggaaaagatattgtgaacccaaactgaaagattataattattacttgcaagtgggaaaaatgtatttcttcatattttgatacatagtcagttatgttttaatcagctttactgaggtataatttacatacaataaaattcagtgactttaa

SEQ ID NO: 173856 - DNA, 542 bp, Homo sapiens
  Payload ID: 14136
  Gene Symbol: RANBP17
  Gene Name: RAN binding protein 17
  ENST ID: ENST00000519944
  CDS Start-End: 429-542
atgtagtaagcccgacacattaccttttgacttcatgccatttctaagggtcctcaggtcaaaataatgtattaccactttagtaaatatgccctctgggaaattttcacaggaagaatcttacaaggaggatttatggattgtaaataggtaatcagatgttcacagagcccgagtaaatcttgagagtaaattaaaagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggttt

SEQ ID NO: 173857 - DNA, 4573 bp, Homo sapiens
  Payload ID: 14136
  Gene Symbol: RANBP17
  Gene Name: RAN binding protein 17
  ENST ID: ENST00000520864
  CDS Start-End: 1-1664
tggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccaggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtatccttattacactgtgacaataccagctctgtgcacagagggatgccaggcccctcgctttcgtttaatagtatggcacagtagggaagaggaaacaaagctaaatgaactaatgtgtaatcagctaaaaattacagcacagtggcagcagagcagataactgagcacagtatttggagacccagctcagagaagtcacttttttggtgccgttaaatattgataacttaaaaatgacttcccccaaatgattgtttatgttggagttgaagggataatctggctaacatctttagggatcaatgaatcctaccatttgacatttttgaggggagatttgaatctccatctcaattagcaaggctgggaagatcattttatctcttcaaggcctaacccatcatgccacagtttttcattatcatgaagataatgaatggacatggaaagggaaaaataaataagtcaaggtttgtcatttggtgtaaaatttgaattgacctttgccaagggttagtacagacaggaaaaaaaaaaaaaaccccccacagaaatgccttatcatgtaagagttaaaagagcatagactttggtgatagacagacccggcttaaaatcccagctcttcatttactgtgttgtgaaccttggcaagtcatttcacctgtctgagtcttggttttctcatttgaaaacagatacaattcagtatcatggtatattgtaaccattaaaataggtaaagtgtactctgtataatgtctggcacatttttggtagttgtaaatggtcgttaatattgttctaatagtgttgtatgacttatgtttgatcccagcaggaagtgatattgtatgcaagtcatctaagtgttatataatgctttcatgtcttttatgcatgaaaccatcagagcatgtgaaaaaaattatataatctgaaagctaatttactttttaatctaaactatttctcagttactttttttaaaccctccttatccaaagtttcctgtaaattaaattgcaatagaaacttcttaaaggtaactgtcaactactatgccacagttatggccaaaaatataactaataggggatctaggcatgttttagggagaactctacatattataaaaatttttaaacattaatttgatactgacatatctttaattattattaaaatatacttcatcagatttatgtacccagagaagggttacagataaaatttttatgtcattgagtaatcatgcacatggtttttatctacatataatatgtacagagattatgaaatttcaacatggaaagtcttaaaattctcttaacagtgacagttaaactggaattatatatgacccttttatttctgccttttttttaatttttaagatacggggtcttgtatgttgctcaggctggactcaaactcctgggctcaagcgatcctcccacctcagcctcctgactagctgggactgtggtgctacaggtgtgctccactgcacccagcttgactcttttatttctctaaacataaagagcaactctcaaaatcaaaattttcattatttgaaaaataataaaagtctactttgggcactgtaatatcgatggtgatcttgaaaccagtctacaactctaggctatctagtgattaacatttcatgtttttctcttcaacagtttcaaccaagagtcaaggtcagaaaccttcccctcagtgtcaaagaagaactatctgccgtaattgatactgcccaaaatttagagaagatactgtattgttttccatttccttatttagctcctttgggggtagcgggggaacctttctgaaatgaaacttttgtccagcagatggcagaaaatagcaaacggaaaatcttgggacttaatgttttcttgtgaactagaaacctttgtctcctccatttgaccatagatgttgaagttatcagggtcaggggcggagagaagtgtcagttatgccagaagctgtgttagattgccaaatggggtggtttggtactggcgttgcttataataattgagtttcagtagcaaatcagcttccttgggaaaaggccaagggcttttcataattgtattgacaacaaaatgaatatgataaatggtgttcattcagttgagacaagatttatagttttcctttgggcgagggatgaagagcaaatatttataataatagtaaaatttgtttaaaagttatattatttgataattcaaaaagctttattaaaatattttgaaatactttaa

SEQ ID NO: 173858 - DNA, 4618 bp, Homo sapiens
  Payload ID: 14136
  Gene Symbol: RANBP17
  Gene Name: RAN binding protein 17
  Uniprot ID: Q9H2T7
  ENST ID: ENST00000519949
  CDS Start-End: 17-1747
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggttgtacgcctgaggagtgatgtacccagagttccagagaaggcttggaaaatagttaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 173859 - DNA, 525 bp, Homo sapiens
  Payload ID: 14136
  Gene Symbol: RANBP17
  Gene Name: RAN binding protein 17
  ENST ID: ENST00000522734
  CDS Start-End: 1-525
cttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagtt

SEQ ID NO: 173860 - DNA, 4558 bp, Homo sapiens
  Payload ID: 14136
  Gene Symbol: RANBP17
  Gene Name: RAN binding protein 17
  Uniprot ID: Q9H2T7
  ENST ID: ENST00000522533
  CDS Start-End: 17-1747
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaagaagacagacatcttcctgtgaagggcttgtggcaaacctatccaactcgggtttcttcttccttgagaacgatctgattcatcatcatctgaaccagggatcacagtctaaggtccaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 173861 - DNA, 4739 bp, Homo sapiens
  Payload ID: 14136
  Gene Symbol: RANBP17
  Gene Name: RAN binding protein 17
  ENST ID: ENST00000522066
  CDS Start-End: 17-1759
gccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggaagttgctggagactgtatactactcaattaaaaaagtaaaccaagaaaagaggaagaagggagagatgggatctgagaatcagaggatcaaacacaggagagaggctaagggaagctctcggataacagctgtgcctcaggccttgagagcaaccagttcaaactggagcagatggaagaagacagacatcttcctgtgaagggcttgtggcaaacctatccaactcgggtttcttcttccttgagaacgatctgattcatcatcatctgaaccagggatcacagtctaaggtccaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctca

SEQ ID NO: 173862 - DNA, 1557 bp, Homo sapiens
  Payload ID: 14136
  Gene Symbol: RANBP17
  Gene Name: RAN binding protein 17
  ENST ID: ENST00000616486
  CDS Start-End: 1-1557
gtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggatatccttttcactcccgctgtgttcaaatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctga

SEQ ID NO: 173863 - DNA, 11711 bp, Homo sapiens
  Payload ID: 14137
  Gene Symbol: RANBP2
  Gene Name: RAN binding protein 2
  Uniprot ID: P49792
  ENST ID: ENST00000283195
  CDS Start-End: 127-9801
cacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcagtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaggactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaca

SEQ ID NO: 173864 - DNA, 367 bp, Homo sapiens
  Payload ID: 14137
  Gene Symbol: RANBP2
  Gene Name: RAN binding protein 2
  ENST ID: ENST00000425282
  CDS Start-End: 55-210
gctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaacgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtga

SEQ ID NO: 173865 - DNA, 156 bp, Homo sapiens
  Payload ID: 14137
  Gene Symbol: RANBP2
  Gene Name: RAN binding protein 2
  ENST ID: ENST00000629728
  CDS Start-End: 1-156
atgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaacgttcagtggaattaa

SEQ ID NO: 173866 - DNA, 1762 bp, Homo sapiens
  Payload ID: 14138
  Gene Symbol: RANBP3
  Gene Name: RAN binding protein 3
  Uniprot ID: Q9H6Z4
  ENST ID: ENST00000034275
  CDS Start-End: 5-1504
taaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaa

SEQ ID NO: 173867 - DNA, 3233 bp, Homo sapiens
  Payload ID: 14138
  Gene Symbol: RANBP3
  Gene Name: RAN binding protein 3
  Uniprot ID: Q9H6Z4
  ENST ID: ENST00000340578
  CDS Start-End: 59-1762
agaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 173868 - DNA, 3186 bp, Homo sapiens
  Payload ID: 14138
  Gene Symbol: RANBP3
  Gene Name: RAN binding protein 3
  Uniprot ID: Q9H6Z4
  ENST ID: ENST00000439268
  CDS Start-End: 27-1715
cttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 173869 - DNA, 568 bp, Homo sapiens
  Payload ID: 14138
  Gene Symbol: RANBP3
  Gene Name: RAN binding protein 3
  ENST ID: ENST00000588010
  CDS Start-End: 12-233
aaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcaggcgccttccaggcctgctgatcggacgagacttctgttgtaatttggaaatgttctccctggttctccaggcccgaagtcactgaggccaagaccatagtcctctcctgcccttgccccccaggcccagccccagcccaggcaggcctgctgttgatattttgtcttgtgcttttagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaa

SEQ ID NO: 173870 - DNA, 547 bp, Homo sapiens
  Payload ID: 14138
  Gene Symbol: RANBP3
  Gene Name: RAN binding protein 3
  ENST ID: ENST00000587479
  CDS Start-End: 83-547
gcagaaagcaggcgagcctgggccggcgcggggccttgtgggagggcttaaggaagtaaaatggcggacctggcgaacgaagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaa

SEQ ID NO: 173871 - DNA, 562 bp, Homo sapiens
  Payload ID: 14138
  Gene Symbol: RANBP3
  Gene Name: RAN binding protein 3
  ENST ID: ENST00000592133
  CDS Start-End: 33-278
agtaaaatggcggacctggcgaacgaagggttatgctgcattgtaggctgacatcaggatttgaaggcagagttttgtccctggcaaaggtaaagaagactggaaagaggaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggt

SEQ ID NO: 173872 - DNA, 1783 bp, Homo sapiens
  Payload ID: 14138
  Gene Symbol: RANBP3
  Gene Name: RAN binding protein 3
  ENST ID: ENST00000591092
  CDS Start-End: 12-1496
aaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttct

SEQ ID NO: 173873 - DNA, 786 bp, Homo sapiens
  Payload ID: 14138
  Gene Symbol: RANBP3
  Gene Name: RAN binding protein 3
  ENST ID: ENST00000590623
  CDS Start-End: 634-786
cttaaggaagtaaaatggcggacctggcgaacgaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttg

SEQ ID NO: 173874 - DNA, 557 bp, Homo sapiens
  Payload ID: 14138
  Gene Symbol: RANBP3
  Gene Name: RAN binding protein 3
  ENST ID: ENST00000591333
  CDS Start-End: 139-557
aaggaagtaaaatggcggacctggcgaacgaaggatgttggtgtaagccacctcctaaggtggttgtggagattaggtgacatgatgcagataaaacctaacacataaagaagtgctcgaagaacgctggccacgtatatgaaaccatcacgcgtctgggagaccccatttgtggatgcctttgctgtgcatatcatggcagaaactaagataagtctaagagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgt

SEQ ID NO: 173875 - DNA, 573 bp, Homo sapiens
  Payload ID: 14138
  Gene Symbol: RANBP3
  Gene Name: RAN binding protein 3
  ENST ID: ENST00000591736
  CDS Start-End: 59-573
agaaagcaggcgagcctgggccggcgcggggccttgtgggagggcttaaggaagtaaaatggcggacctggcgaacgaagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcct

SEQ ID NO: 173876 - DNA, 1937 bp, Homo sapiens
  Payload ID: 14138
  Gene Symbol: RANBP3
  Gene Name: RAN binding protein 3
  ENST ID: ENST00000592771
  CDS Start-End: 4-228
aaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaagaaaatttctggaaggaatgagaagagaccacccttgttttcgtggagcagggcctgtgacagggacctccagattttggctacccctggagcacgccttgtctgtctgcagctctggagagggccacgctctgggcctagcactagtggcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactggg

SEQ ID NO: 173877 - DNA, 461 bp, Homo sapiens
  Payload ID: 14138
  Gene Symbol: RANBP3
  Gene Name: RAN binding protein 3
  ENST ID: ENST00000587463
  CDS Start-End: 59-247
agaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaaggtaaggggccgaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcct

SEQ ID NO: 173878 - DNA, 579 bp, Homo sapiens
  Payload ID: 14138
  Gene Symbol: RANBP3
  Gene Name: RAN binding protein 3
  ENST ID: ENST00000587263
  CDS Start-End: 12-338
aaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcaggggaagaagaaaagactcttcctttgaacccagaaggaatcccctgagccctttatctttgtattaagaagccttttgaagattataggtggagaagattgtgaactctcaagaacaagaaatgtcttgggtttttgaagtttgataaattgggaaagaggtcagctggcggctccagtcctgaaggcggagaagattctgacagagaagatggaaattactgccctcctgtcaagcgagaaagaacatcctctttaacccagttcccaccctcacagtcagaggaaa

SEQ ID NO: 173879 - DNA, 566 bp, Homo sapiens
  Payload ID: 14138
  Gene Symbol: RANBP3
  Gene Name: RAN binding protein 3
  ENST ID: ENST00000585339
  CDS Start-End: 12-128
aaggaagtaaaatggcggacctggcgaacgaagacggggtttcaccatgttggccaggatggtctccatctcctgacctcgtgatctgcccgcctcggcctcccaaagtgctgggattacaggcgtgagccaccgcacccggctgctacatctctttttttaagataaaggagcccatggagggttgcagcattccaactcatgagatctagttacagagggactggaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactg

SEQ ID NO: 173880 - DNA, 490 bp, Homo sapiens
  Payload ID: 14138
  Gene Symbol: RANBP3
  Gene Name: RAN binding protein 3
  ENST ID: ENST00000589353
  CDS Start-End: 38-271
aaggaagtaaaatggcggacctggcgaacgaagggttatgctgcattgtaggctgacatcaggatttgaaggcagagttttgtccctggcaaaggtaaagaagactggaaagaggaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccag

SEQ ID NO: 173881 - DNA, 818 bp, Homo sapiens
  Payload ID: 14138
  Gene Symbol: RANBP3
  Gene Name: RAN binding protein 3
  ENST ID: ENST00000592621
  CDS Start-End: 453-818
gcggacctggcgaacgaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacag

SEQ ID NO: 173882 - DNA, 3104 bp, Homo sapiens
  Payload ID: 14139
  Gene Symbol: RANBP3L
  Gene Name: RAN binding protein 3-like
  Uniprot ID: Q86VV4
  ENST ID: ENST00000296604
  CDS Start-End: 487-1884
acagagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattataaattgctagatttgataaatacctaacaaaatgtttatttttttcagtcatacttgaccacaaaacaaatattttactaaatttccagagtcatttctctgaaaaatagtataatggcatgataacatttcactaaatcctatttatcttctgggaaatattttaatttagcttttggatttcctaatatgataagcttatatattcatggtatgaattcctttaaaaagagcatctgctcttggacttgtatctgttgcatcttgtcaatgtttgactcatggtcagcatccaatagttgttaaatgaataaataaaatataatacattacctatgtatcaaaaagcatgtgtaagaaagccaaatatgttaactgttctactttatttatgtaattatattttcattagtattttagtagatggggctgtatagaaaaacaaatgtatcatatgtagccaaatgaatctttttcttaaatgatattattatagtaggctacagtaatttcaacaattttacaatagagttttgatcctcttctttgcgatttgtttcagagacacctcatgaatcacacaagaaaattagtctcagtacttatagccctatttcatttttcaattcagttttatcacaccatggcttcgaagtgactttgattgtgacccctaagcaattatctgattaggggataaaaattcataattccaagatgtttctgaaaatgttctgaacaatgacaacatatttggaatgagggcgtaatttcactaagtgatgcttcgaagaacaatattcatttggatatgcaaacacacattttcaaaagttatattactgtgttaccatacctgttataaaataataaaaatatataagtatttattaagtcaaa

SEQ ID NO: 173883 - DNA, 1532 bp, Homo sapiens
  Payload ID: 14139
  Gene Symbol: RANBP3L
  Gene Name: RAN binding protein 3-like
  Uniprot ID: Q86VV4
  ENST ID: ENST00000515759
  CDS Start-End: 485-1450
agagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaaggtctgtatatcatgttttactctttctggtagcatttacatacttggaataaagttaacatgagaagaggcatctttaaaaatacagacagaagtatagttttcatggagactaagttgcttaaataaaaatgttggatgctctc

SEQ ID NO: 173884 - DNA, 2278 bp, Homo sapiens
  Payload ID: 14139
  Gene Symbol: RANBP3L
  Gene Name: RAN binding protein 3-like
  Uniprot ID: Q86VV4
  ENST ID: ENST00000502994
  CDS Start-End: 485-1957
agagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgtcaaccttgtctcagaagcaaatgagatgttcatccgtcactaacctcccaaccttcccccattctgggccagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccaggactttttaggtgcaacatcagtaggatgtcaaccaaatgaagataaatgttcttttaaaagctgcagttccaattttgtttttggagaaaacatggtagaaagagttttgggtactcaaaaactcacccagcctcaacttgaaaatgattcatatgccaaggaaaaaccattcaaatccattccgaaatttcctgtcaactttttaagttcaagaacagactctattaaaaatacttccctaattgaatcagctgctgcattctcttcccaaccatcacgaaaatgcttgctggagaaaattgatgttataacaggggaggaaacagaacataatgtgttaaagataaactgcaagcttttcatattcaacaaaacaacacaatcctggattgaaaggggcagaggaacgttgagactgaatgacacagcaagcactgactgtggaacattacagtcaagactaattatgcgcaatcaaggcagtctaaggctgatcctcaacagcaaactctgggcccaaatgaagattcaaagagcaaaccacaaaaatgtacgaataacagctactgatttagaagactatagcatcaaaatatttttaattcaggccagtgcccaagatacagcatatttgtatgcagcaatacatcatcgtcttgttgcacttcaaagcttcaataagcagagagatgtcaatcaagctgaaagcctgtcagaaacagcccaacaattgaactgcgaaagctgtgatgagaatgaggatgatttcatccaagtcactaaaaatggatcagatccttctagttggactcacagacagtcggttgcctgttcatgaatactacctactataaacatgacatctacaaaaagaggggtcaccctactgaaaatactaaaccaccctaactaatgagaagattctattcattccttgaagagtttttatagaaaagtttaagaaatgtaatttgttgcaattaacatttttatgttttacattttacattttgattattgtgcagaaactgacagaatttaaaaaaatggacttcagaagttcaaaatttatcatttttgaagaagtttatttagaataggattttataactaatttggactcttcatcacattgatggatataatacttagaattata

SEQ ID NO: 173885 - DNA, 572 bp, Homo sapiens
  Payload ID: 14139
  Gene Symbol: RANBP3L
  Gene Name: RAN binding protein 3-like
  ENST ID: ENST00000505865
  CDS Start-End: 247-572
agcttgcattttaattacaaacaaagtagcagaaatcaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaacaaagcgtgtacggtcttcatcttttacttttcatattacagattctcagtcccagggagtgaggaaaaacaatgtttttatgacatcagctcttgtgcaaagtagtgttgatataaa

SEQ ID NO: 173886 - DNA, 4576 bp, Homo sapiens
  Payload ID: 14140
  Gene Symbol: RANBP6
  Gene Name: RAN binding protein 6
  Uniprot ID: O60518
  ENST ID: ENST00000259569
  CDS Start-End: 12-3329
gacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggtgagacaaatggctgccgcactgctacgacggcttttgtcctctgggtttgaggaggtttatccaaatctgcctgctgatgttcagagagatgtcaagattgaactgattctggctgttaagttagaaacacatgctagcatgaggaaaaaactttgtgatatttttgcagtgctggccaggaatttgatagatgaggatggcactaaccactggccggaaggtctgaagtttcttattgattcaatctactccaaaaatgtggttctatgggaagttgcacttcacgttttctggcactttcctgggatttttgggacccaagagcggcatgatttggatatcatcaaacggttgttggaccagtgtattcaagatcaagaacatccagcaatcaggacattatccgctagagctgcagctgcatttgtacttgctaatgagaataatattgctcttttcaaagactttgcagacttgcttcctggaatcttacaggctgtgaatgactcatgctaccaggatgatgattcagtgctagaatcccttgttgagattgcagataccgtacctaagtacttgggtccttatttagaagatactctacagttgagtttgaagttatgtggagactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagcatatcatgcagatgcttcagagccctgactggaagtatcgacatgctggattaatggccttatctgccattggagaaggatgccatcaacaaatggaatcaattctagatgaaacagttaactccgttttgctttttcttcaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggtttgtggaatatacagaacaagttgtgaagctgatggttcctttactgaaattttatttccatgacaatgttcgagtggcagcagcagagtccatgccttttctcctggaatgtgcaagaattcgtggcccagagtatcttgcacagatgtggcaattcatatgtgaccccttaatcaaggctattggtactgaaccagatacagatgtgctctcagaaataatgaattcttttgcaaagtccattgaagttatgggagatggttgccttaatgatgaacacttggaagaactgggaggaatactgaaagcaaaacttgaagggcactttaaaaaccaagaattgagacaggtgaaaagacaggaagaaaactatgatcaacaggttgagatgtctctgcaagatgaggatgaatgtgatgtttatattctgaccaaagtatcagatattttgcactcattatttagtacttataaggaaaagattttaccatggtttgaacaactacttccattaattgtaaatctaatttgttcaagtaggccatggccagacagacagtggggattgtgcatatttgatgacatcatagagcactgcagtccaacttcatttaaatatgtagaatattttcggtggccaatgctactaaatatgcgagataacaaccctgaagtcaggcaagctgctgcttatggcctgggtgtcatggcacagtttggtggagatgattatcgttctttatgttcagaagctgttccacttctggtaaaagttattaagtgtgcaaattccaaaaccaaaaaaaatgtcattgctacagagaactgtatctcagcaatagggaagattttgaagtttaagcctaactgtgtaaatgtagatgaagttcttccacactggttatcatggcttccactgcatgaagataaagaggaagctattcagactttgagttttctctgtgacctaattgaaagtaaccacccagttgtaattggtccaaataattccaatcttcccaaaataatcagtataattgcagaaggaaaaattaatgagactattaactatgaggatccttgtgccaaacgcctagctaatgtcgtgcgtcaggtacagacttctgaagatttatggttggaatgtgtatcacaacttgatgatgaacagcaggaagccttacaggagttgctaaattttgcttgaagcactttaatataacttgaatattatctattataaaagtaactacaaataagtgttgtgaatagattttattataaatcagagaactgttttctccctgctaagcagtttatagttcttctccatgtttctccagaattaatcagtgttagtcctctgtttatctcgcatgttttatcttccaaacacagaccttggtgataacctgtgcttcaaactgtcttaaacaatgtttgtcacctttcccctagttgatgtaaagtatataaattgttgctatttgtttgaactattattgatgctagccaagcagtatacttgatgtgaagatgtcatgctatcacaatatgctaagagctcacaaaaataagatagaatttccaggacaaacatctttggaattgtgagtgaaggatatagtggcaggcttgtccctctttaattaatactcttggtatttgtggtgatgggaggatgctgttactaggagagttttgagatactgcagtggatgtgggatgtatatgaacttcttcataatgtactcctgggaactgggtaggacatatccatattgtagttcccaaggtgtctggttgagagttagagaacttttaaatttctttagccagacaggtctctatttttttaagttatccaggactccaagaaccatagttactgaaaagggagtcctgatacatctaatattggtagcatgtaacagtgtttgacaaagagtaagtaagcagtattcttgggagtcagtgttatgtgtttcagcagagtattattttgtatatgtatgccattttctccctgcaaagcagctcaacaagagaaaaagctctagttatagggcttaaattgatttctatttcaaataatttcctaagagattctagagtagaactgaagagtattctattggaaaagtgaaaggaaagaaatgtaattttctttgaacatgaaaaagaaaacaactttgagagtagtcatttagcagtagatgtgcattattatgagaaaacagttctataagtccagggttaattatattaattggaatgtcagtctttaatgtcgagcttattgtagggtagaaaagagctttctactcagctaacgattactcattgatccaaaacttaaatacatctataatttcctggggctattgtgagtactgtgtatgtatttagcaaatatttaagacctagtaagtgctcaataaattgtagctgtta

SEQ ID NO: 173887 - DNA, 1000 bp, Homo sapiens
  Payload ID: 14140
  Gene Symbol: RANBP6
  Gene Name: RAN binding protein 6
  ENST ID: ENST00000485372
  CDS Start-End: 6-212
gcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatttatgcaagatgcatcaaatgtgatgcagctgttgttgaagacacaatcagacttaaataatatggaagatgatgaccctcagacctcttacatggtttcagcatgggctagaatgtgtaaaattcttggaaaagattttcaacagtaccttccactggttatcgagcctcttattaagactgcttcagctaaacctgatgttgctctcttagacacacaggatgtggaaaatatgagtgacgatgatggctggcaatttgtaaatcttggagaccagcagagttttggaattaaaacttcaggacttgaagcaaaagcaactgcttgccaaatgttggtttactatgctaaggagttaagggaagggt

SEQ ID NO: 173888 - DNA, 704 bp, Homo sapiens
  Payload ID: 14140
  Gene Symbol: RANBP6
  Gene Name: RAN binding protein 6
  ENST ID: ENST00000623170
  CDS Start-End: 19-704
tagctttgacagagcgcaatggcggcaaccgcgtctgcaggggtgccggcgaccgtgtcagaaaagcaagagttttaccagcttctgaagaacctgatcaatccaagctgtatggtgcggaggcaagcagaggaaatctatgaaaatatcccaggtctgtgtaagactaccttcctcttagatgccgtcagaaatagaagagcaggttatgaggatcctcatccaagggtgagggctgcagcctgtactacacttggacagatggctacagattttgcacctaatttccaaaagaaatttcatgaaacagtgattgcagctctgttacgtaccatggaaaatcaaggtaatcagcgtgtgcaatcacatgcagcttctgctcttattatttttattgaagactgccctaaatcattgctagttctatatgtggatagtatggtgaaaaatctacattccgtcttggtgattaaacttcaagagttgattcggaatggaactaagttggctttggaacaacttgtgacaaccattgcatcagttgcagatacaatagaagaaaaatttgtcccatattatgatatattcatgccctcactaaagcacattgttgagcttgctgttcagaaggaactcaagcttctgagaggaaaaactatcgagtgcattagccatattggtcttgctgttgggaaggaaaaatt

SEQ ID NO: 173889 - DNA, 3113 bp, Homo sapiens
  Payload ID: 14141
  Gene Symbol: RANBP9
  Gene Name: RAN binding protein 9
  Uniprot ID: Q96S59
  ENST ID: ENST00000011619
  CDS Start-End: 60-2249
gaagcagaggaggaaggagagaagaggtggaggtggccgcaggctgagtcgcggccgggatgtccgggcagccgccgccgccgccgccgcagcagcagcaacagcagcagcagctgtcgccgccaccgccggcggccttggccccagtctccggagtcgtcctgccggcgcccccggccgtcagcgccggctcttctccggccggctcgcccggcggcggtgcgggcggcgaaggcttaggggccgcggcggccgccctgctcctccaccctccgccgccgccgcccccggccaccgcggccccgccgcccccgccgccgcccccgcctccccctgcctcagcggctgcccccgccagcgggccgcccgctcccccgggccttgcagcgggccccggcccggctggaggagccccgaccccagctctggtggcgggcagcagcgccgcggcccccttccctcacggggactcggccctgaacgagcaggagaaggagttgcagcggcggctgaagcgtctctacccggccgtggacgaacaagagacgccgctgcctcggtcctggagcccgaaggacaagttcagctacatcggcctctctcagaacaacctgcgggtgcactacaaaggtcatggcaaaaccccaaaagatgccgcgtcagttcgagccacgcatccaataccagcagcctgtgggatttattattttgaagtaaaaattgtcagtaagggaagagatggttacatgggaattggtctttctgctcaaggtgtgaacatgaatagactaccaggttgggataagcattcatatggttaccatggggatgatggacattcgttttgttcttctggaactggacaaccttatggaccaactttcactactggtgatgtcattggctgttgtgttaatcttatcaacaatacctgcttttacaccaagaatggacatagtttaggtattgctttcactgacctaccgccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaaaatggtttcatcttatttagtccaccatgggtactgtgccacagcagaggcctttgccagatctacagaccagaccgttctagaagaattagcttccattaagaatagacaaagaattcagaaattggtattagcaggaagaatgggagaagccattgaaacaacacaacagttatacccaagtttacttgaaagaaatcctaatctccttttcacattaaaagtgcgtcagtttatagaaatggtgaatggtacagatagtgaagtacgatgtttgggaggccgaagtccaaagtctcaagacagttatcctgttagtcctcgaccttttagtagtccaagtatgagccccagccatggaatgaatatccacaatttagcatcaggcaaaggaagcaccgcacatttttcaggttttgaaagttgtagtaatggtgtaatatcaaataaagcacatcaatcatattgccatagtaataaacaccagtcatccaacttgaatgtaccagaactaaacagtataaatatgtcaagatcacagcaagttaataacttcaccagtaatgatgtagacatggaaacagatcactactccaatggagttggagaaacttcatccaatggtttcctaaatggtagctctaaacatgaccacgaaatggaagattgtgacaccgaaatggaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggatgcattcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttcaactttgtttcctgtttaactacagatgacttctgttgtagactcacaagtttaactgttgtattataacagtattacatgtcaacggtgtggttatgacctttatttatataaaaaccaaatatttagtcaatttaccgtgtcttaatttaatctttgtacaccttccatttttaagtgcttaaatgagtactatattgcaataaaatgtagtgatataattaaccagccattaaaaatttacttctacaga

SEQ ID NO: 173890 - DNA, 3060 bp, Homo sapiens
  Payload ID: 14142
  Gene Symbol: RANGAP1
  Gene Name: Ran GTPase activating protein 1
  Uniprot ID: P46060
  ENST ID: ENST00000356244
  CDS Start-End: 305-2068
gaacaaatcaaatcgaagcaaagaaactgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgccgcctgtttacgtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 173891 - DNA, 3469 bp, Homo sapiens
  Payload ID: 14142
  Gene Symbol: RANGAP1
  Gene Name: Ran GTPase activating protein 1
  Uniprot ID: P46060
  ENST ID: ENST00000405486
  CDS Start-End: 714-2477
ctttccccgtcacctgcctggaacaggggtgcggggcgaggagggcgtggcgcccgtgtgcgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttca

SEQ ID NO: 173892 - DNA, 759 bp, Homo sapiens
  Payload ID: 14142
  Gene Symbol: RANGAP1
  Gene Name: Ran GTPase activating protein 1
  ENST ID: ENST00000446258
  CDS Start-End: 1-759
agtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcag

SEQ ID NO: 173893 - DNA, 603 bp, Homo sapiens
  Payload ID: 14142
  Gene Symbol: RANGAP1
  Gene Name: Ran GTPase activating protein 1
  ENST ID: ENST00000452543
  CDS Start-End: 204-603
gaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgagg

SEQ ID NO: 173894 - DNA, 4222 bp, Homo sapiens
  Payload ID: 14142
  Gene Symbol: RANGAP1
  Gene Name: Ran GTPase activating protein 1
  Uniprot ID: P46060
  ENST ID: ENST00000455915
  CDS Start-End: 1471-3234
ccctgtctctactaaaaatacaaaaaaattagctggacatggtggtgggtgcctgtaatcccagctactcaggaggctgaggcaggagaatgacatgaaccttggaggcggagcttgcagtgagcccagatggcgccactgtgctccagcctgggcgactgagcgagactccgtctcaaaaaaaaaaaattctttcatttatttagttacttttagagatagagcctcccgctgttgcccaggctggagtgcagtggcagtcatagcttactgcagctttgaactcctgggctcaaatgatcctcctgcctcagcctctccagtagctgggactgactacaggcacgtgccaccacacccagctaatttttatttttatttttatttttttgagacagggttttactctgtcacccaggctagagtgcagtggtgagatcatggctcactgtagcctctgtctccggggctcaatcaatcctcccacctcagcctccccagtggctgggattactggtgcacaccaccataccctgctaattgtatttatttttagtagagatgggattttgccatgttgcccagactggtcttgagctgctgggctcaagcgatcttcccatcacagcttcccaatgtgctgggattacaggtgtgagccactgtacctggccagctttacttcttttaccagcactcctgattttataaatagtgaggcttatcaaccccatttctacccaaatcttctggtagacttgagtatagtagggcttcataggtagcagccctgtccctgtcctattatgatggtagctgttgtgatgtggcgatctctgatctagaaacccctgaggggccattgtggcctgcccagtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttctctgatgctgttttcctttcttccagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctgatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaagatcctggctgcagctctgaccgaatgtcaccggaaatccagtgcccaaggcaagcctctggccctgaaggtctttgtggctggcagaaaccgtctggagaatgatggcgccactgccttggcagaagcttttagggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgagaccttgaagaccttgcggcaggtggaggtgattaattttggggactgcctggtgcgctccaagggtgcagttgccattgcagatgccatccgcggcggcctgcccaagctaaaggagctgaacttgtcattctgtgaaatcaagagggatgctgccctggctgttgctgaggccatggcagacaaagctgagctggagaagctggacctgaatggcaacaccctgggagaagaaggctgtgaacagcttcaggaggtgctggagggcttcaacatggccaaggtgctggcgtccctcagtgatgacgaggacgaggaggaggaggaggaaggagaagaggaagaagaggaagcagaagaagaggaggaggaagatgaggaagaggaggaagaagaggaggaggaggaggaagaagagcctcagcagcgagggcagggagagaagtcagccacgccctcacggaagattctggaccctaacactggggagccagctcccgtgctgtcctccccacctcctgcagacgtctccaccttcctggcttttccctctccagagaagctgctgcgcctagggcccaagagctccgtgctgatagcccagcagactgacacgtctgaccccgagaaggtggtctctgccttcctaaaggtgtcatctgtgttcaaggacgaagctactgtgaggatggcagtgcaggatgcagtagatgccctgatgcagaaggctttcaactcctcgtccttcaactccaacaccttcctcaccaggctgctcgtgcacatgggtctgctcaagagtgaagacaaggtcaaggccattgccaacctgtacggccccctgatggcgctgaaccacatggtgcagcaggactatttccccaaggcccttgcacccctgctgctggcgttcgtgaccaagcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagc

SEQ ID NO: 173895 - DNA, 946 bp, Homo sapiens
  Payload ID: 14142
  Gene Symbol: RANGAP1
  Gene Name: Ran GTPase activating protein 1
  ENST ID: ENST00000422838
  CDS Start-End: 835-946
cgccttctgcctgccccctcggccttcttcacttagccttcgacggccgagcgccccaggggtggcggtgggagtggggttgttgagcggcgctggctcctttcacaaatggggaaactgaggcttaaagggcgtctgactcgccagagcagctcagcctgcagctgctagcagtggcgtctcatattagcattgttgtcaaccggaggcggtgcgagtccgccggggattccagatggggctcctgcgccgcccgcctatcatttgcggcctgtattcgcgcgtcgctcccgcagagccacctcccagcaggcccacgcccgcgggggccccgggctggcgccgctgtccctggaatcgatgtgagtcactgctgacgctttgcaggagcatgcatctcacctcagaaagtctctgacgttgctgcggagcggggagaggatgtttctctattagccctttgcttttgctctggcgctgatcctttgctgaccttggacaaatcaatttacgtttctgtgctccagtttcttggtttataaaagacggtctccttctgtcacccaggctggagtgtagtggaacgatcaccgctgaactgcagcgtcggcttcctgggctcaagcgatcctcccacctcaacctcccaagtcatggggactacagatgccatcacacctggctaatttttaaatttttctgtggagacagggtctcattctgttgcccaggcttgtctcgaaccctggtctaaagtgatcttcccgcctagcctcccaaaatgttggaattacagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatg

SEQ ID NO: 173896 - DNA, 650 bp, Homo sapiens
  Payload ID: 14142
  Gene Symbol: RANGAP1
  Gene Name: Ran GTPase activating protein 1
  ENST ID: ENST00000418067
  CDS Start-End: 351-650
gtctcccggccacggttgaaaccagacgtgcagtggggctgacccctgtgccccaccccagagtcatgccagcgtgggtggtggggcattctctgggatgaatgatctggatcccatagccatctgtgtcctgtttgaggaatgggaccctcaaacagagaacagccaagatgctcaagcagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatgctaaagatgtgattaaagagattgaagactttgacagcttggaggctctgcgtctggaaggcaacacagtgggcgtggaagcagccagggtcatcgccaaggccttagagaagaagtcggagttgaagcgctgccactggagtgacatgttcacgggaaggctgcggaccgagatcccaccagccctg

SEQ ID NO: 173897 - DNA, 1009 bp, Homo sapiens
  Payload ID: 14143
  Gene Symbol: RANGRF
  Gene Name: RAN guanine nucleotide release factor
  Uniprot ID: Q9HD47
  ENST ID: ENST00000226105
  CDS Start-End: 293-853
gggggcgacatagaccctaaccctaagtccaaccccaaggcagaccccaccgtcccgccaggcgcactcctaagagcgcggcttccggagcaaagccgctgacccccgcccccagggtcttggcgccgattggccaacgagagcgcagggcggagccaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatataa

SEQ ID NO: 173898 - DNA, 1074 bp, Homo sapiens
  Payload ID: 14143
  Gene Symbol: RANGRF
  Gene Name: RAN guanine nucleotide release factor
  Uniprot ID: Q9HD47
  ENST ID: ENST00000407006
  CDS Start-End: 136-576
aaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtagcaaaggacgtgacacttcatcaggccttgctgaggctgccccagtaccagactgatctcttgcttaccttcaatcagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatat

SEQ ID NO: 173899 - DNA, 1140 bp, Homo sapiens
  Payload ID: 14143
  Gene Symbol: RANGRF
  Gene Name: RAN guanine nucleotide release factor
  Uniprot ID: Q9HD47
  ENST ID: ENST00000439238
  CDS Start-End: 112-609
agccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcaggtgagggcccgagagtgtgtaatgtcctggaagggcggtagcggggacgcagagatccaggtaagcatcctgactctgatccccttaggtagcaaaggacgtgacacttcatcaggccttgctgaggctgccccagtaccagactgatctcttgcttaccttcaatcagcccccgtaaggaggaaggaacgggcgggtatctcatgactgggttcccaggagaatcgggctgggagggacagaacagggagactcactggtgggatcctccaaggaagcaggagtgggccagaggtttggggtaactgatacccaggtcctctggggaacaggaattggcaatttccaaacctcaggcctggatgatgttctgtctccatctgttcccccaccccaagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatataa

SEQ ID NO: 173900 - DNA, 749 bp, Homo sapiens
  Payload ID: 14143
  Gene Symbol: RANGRF
  Gene Name: RAN guanine nucleotide release factor
  Uniprot ID: Q9HD47
  ENST ID: ENST00000580434
  CDS Start-End: 119-475
ggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatgggggccattgacgtaagcgacctccgaccggtcccggacaatcaagaagttttctgccatcccgtgacggaccagagcctgatagtggaacttctcgagctgcaggcccacgtacggggcgaagcggctgcgcggtaccactttgaggatgttggtggcgtgcagggggctagggctgtccatgtggagtctgttcagcctctcagtttggagaacctggccctgaggggccgctgtcaagaagcctgggtcctctctggcaagcagcagatagctaaggaaaaccagcagccctgacaacaggtcatctcttggccccgaaaatctgtcacctgcaccctggagcctgggtgactttgaacagctggtgaccagtctgacccttcacgatcctaacatctttggtccccagtaaaggcgctgaagcactgcatgatgttgctgagaacttggggactcggttctgtgagggggaaaagaggttgaaaagagggtttcctcttatttcttccctgtgcgtaaacataagacaatccctcttcagaataaacttgctttataatcaatataa

SEQ ID NO: 173901 - DNA, 780 bp, Homo sapiens
  Payload ID: 14144
  Gene Symbol: RAN
  Gene Name: RAN, member RAS oncogene family
  ENST ID: ENST00000392367
  CDS Start-End: 42-743
agtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagagatggggattcaccatgttgcccatgctggtctggaactcatgagctcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagtttt

SEQ ID NO: 173902 - DNA, 1530 bp, Homo sapiens
  Payload ID: 14144
  Gene Symbol: RAN
  Gene Name: RAN, member RAS oncogene family
  Uniprot ID: P62826
  ENST ID: ENST00000392369
  CDS Start-End: 525-1175
tgcgcttccgccatctttccagcctcagtcggacgggcgcggagacgcttctggaaggtatcgcgacccggcgggcccggcacggccgggcggggacaggggtggcggcggcgggataggggtcggagccggggccagggccggggcgggtggcggacccaggggcagcgggcggctgagtaggtgggtggtgcgggcccggccgggccggggcaggagacgggcgtggggtcggcgctagcccccgcgaacccccgtttcatcctccgctctcatccccgtcccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaa

SEQ ID NO: 173903 - DNA, 2455 bp, Homo sapiens
  Payload ID: 14144
  Gene Symbol: RAN
  Gene Name: RAN, member RAS oncogene family
  ENST ID: ENST00000448750
  CDS Start-End: 1-705
cgccggcgtcggctgcgtctccggcgtttgaattgcgcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctg

SEQ ID NO: 173904 - DNA, 572 bp, Homo sapiens
  Payload ID: 14144
  Gene Symbol: RAN
  Gene Name: RAN, member RAS oncogene family
  ENST ID: ENST00000536606
  CDS Start-End: 1-311
ggctgcgtctccggcgtttgaattgcgcttccgccatctttccagcctcagtcggacgggcgcggagacgcttctggaagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgc

SEQ ID NO: 173905 - DNA, 1475 bp, Homo sapiens
  Payload ID: 14144
  Gene Symbol: RAN
  Gene Name: RAN, member RAS oncogene family
  ENST ID: ENST00000541630
  CDS Start-End: 282-668
gaattgcgcttccgccatctttccagcctcagtcggacgggcgcggagacgcttctggaagcttgtattggttggtgatggtggtactggaaaaacgaccttcgtgaaacgtcatttgactggtgaatttgagaagaaccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggtt

SEQ ID NO: 173906 - DNA, 657 bp, Homo sapiens
  Payload ID: 14144
  Gene Symbol: RAN
  Gene Name: RAN, member RAS oncogene family
  ENST ID: ENST00000535090
  CDS Start-End: 62-657
tccgccatctttccagcctcagtcggacgggcgcggagacgcttctggaaggaacgccgcgatggctgcgcagggagagccccagcttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggt

SEQ ID NO: 173907 - DNA, 2661 bp, Homo sapiens
  Payload ID: 14144
  Gene Symbol: RAN
  Gene Name: RAN, member RAS oncogene family
  Uniprot ID: P62826
  ENST ID: ENST00000543796
  CDS Start-End: 259-909
accgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggaacgccgcgatggctgcgcagggagagccccaggtccagttcaaacttgtattggttggtgatggtggtactggaaaaacgaccttcgtgaaacgtcatttgactggtgaatttgagaagaagtatgtagccaccttgggtgttgaggttcatcccctagtgttccacaccaacagaggacctattaagttcaatgtatgggacacagccggccaggagaaattcggtggactgagagatggctattatatccaagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaacagttgaaatttggaagtgacgtcacttacctgtctaacgtggtgtgggagagaatttacaagtcctttattgaaagaataattgttgcaaaatatattgcttctactttgcctgga

SEQ ID NO: 173908 - DNA, 572 bp, Homo sapiens
  Payload ID: 14144
  Gene Symbol: RAN
  Gene Name: RAN, member RAS oncogene family
  ENST ID: ENST00000541679
  CDS Start-End: 56-217
atctttccagcctcagtcggacgggcgcggagacgcttctggaaggaacgccgcgatggctgcgcagggagagccccaggtccagttcaaaccttcctctggcttgctaggaagctcattggagaccctaacttggaatttgttgccatgcctgctctcgccccaccagaagttgtcatggacccagctttggcagcacagtatgagcacgacttagaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattccca

SEQ ID NO: 173909 - DNA, 5498 bp, Homo sapiens
  Payload ID: 14145
  Gene Symbol: RGPD1
  Gene Name: RANBP2-like and GRIP domain containing 1
  ENST ID: ENST00000398193
  CDS Start-End: 39-5309
ctggtttcacgcgtctcgggagccaggttggcggtgcgatgaggcgcagcaaggcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttg

SEQ ID NO: 173910 - DNA, 6692 bp, Homo sapiens
  Payload ID: 14145
  Gene Symbol: RGPD1
  Gene Name: RANBP2-like and GRIP domain containing 1
  Uniprot ID: P0DJD0
  ENST ID: ENST00000409776
  CDS Start-End: 17-5263
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagt

SEQ ID NO: 173911 - DNA, 3479 bp, Homo sapiens
  Payload ID: 14145
  Gene Symbol: RGPD1
  Gene Name: RANBP2-like and GRIP domain containing 1
  ENST ID: ENST00000428128
  CDS Start-End: 1-95
tacatggaaatatagaagatgctgtgactgcttttgaatctataaaaagtgttgtttcttattggaatcttgcactggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaa

SEQ ID NO: 173912 - DNA, 6697 bp, Homo sapiens
  Payload ID: 14145
  Gene Symbol: RGPD1
  Gene Name: RANBP2-like and GRIP domain containing 1
  Uniprot ID: P0DJD0
  ENST ID: ENST00000559485
  CDS Start-End: 17-5263
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaa

SEQ ID NO: 173913 - DNA, 6931 bp, Homo sapiens
  Payload ID: 14146
  Gene Symbol: RGPD2
  Gene Name: RANBP2-like and GRIP domain containing 2
  Uniprot ID: P0DJD1
  ENST ID: ENST00000398146
  CDS Start-End: 224-5494
caagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaa

SEQ ID NO: 173914 - DNA, 5510 bp, Homo sapiens
  Payload ID: 14147
  Gene Symbol: RGPD3
  Gene Name: RANBP2-like and GRIP domain containing 3
  ENST ID: ENST00000304514
  CDS Start-End: 39-5321
ctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaagaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaacgatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttg

SEQ ID NO: 173915 - DNA, 5594 bp, Homo sapiens
  Payload ID: 14147
  Gene Symbol: RGPD3
  Gene Name: RANBP2-like and GRIP domain containing 3
  Uniprot ID: A6NKT7
  ENST ID: ENST00000409886
  CDS Start-End: 89-5365
gctttcaggcgctttcctcttggaattggcgactgctgcggggctgagcgctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttacaaaaatggttcatgtgtattaccatcattcttttgtcaaaaagtgtgtatatgtttgcatttacatatatttgtacatctatatgacagatgtattttaaaagtttcaacttgaagtaaaagta

SEQ ID NO: 173916 - DNA, 5464 bp, Homo sapiens
  Payload ID: 14148
  Gene Symbol: RGPD4
  Gene Name: RANBP2-like and GRIP domain containing 4
  Uniprot ID: Q7Z3J3
  ENST ID: ENST00000408999
  CDS Start-End: 78-5354
ctttcctgttggaattggcgactgctgcggggctgagcgctggtttcacgcgtctcgggagccaggttggtggcgcgatgagttgcagcaaggcctacggggagcggtacgtcgcctccgtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacacaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttacaaaaa

SEQ ID NO: 173917 - DNA, 7253 bp, Homo sapiens
  Payload ID: 14149
  Gene Symbol: RGPD5
  Gene Name: RANBP2-like and GRIP domain containing 5
  Uniprot ID: Q99666
  ENST ID: ENST00000016946
  CDS Start-End: 159-5456
gtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatatttttatggctgc

SEQ ID NO: 173918 - DNA, 2907 bp, Homo sapiens
  Payload ID: 14149
  Gene Symbol: RGPD5
  Gene Name: RANBP2-like and GRIP domain containing 5
  Uniprot ID: Q99666
  ENST ID: ENST00000272454
  CDS Start-End: 193-2907
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctga

SEQ ID NO: 173919 - DNA, 3304 bp, Homo sapiens
  Payload ID: 14149
  Gene Symbol: RGPD5
  Gene Name: RANBP2-like and GRIP domain containing 5
  Uniprot ID: Q99666
  ENST ID: ENST00000393283
  CDS Start-End: 534-3248
ataaaccccagggctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactctggacactgaactgactttggaaccagactgcagaatggaggggtgggaacttgtggcttgaacctaatcaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 173920 - DNA, 563 bp, Homo sapiens
  Payload ID: 14149
  Gene Symbol: RGPD5
  Gene Name: RANBP2-like and GRIP domain containing 5
  ENST ID: ENST00000430736
  CDS Start-End: 162-563
acagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaag

SEQ ID NO: 173921 - DNA, 568 bp, Homo sapiens
  Payload ID: 14149
  Gene Symbol: RGPD5
  Gene Name: RANBP2-like and GRIP domain containing 5
  ENST ID: ENST00000432606
  CDS Start-End: 399-568
ctgttgaggcgccggccggctggcgcagtcctgtgggcggcgtggcgcttgcaagcgcaggaagagtcctggggggaccgcggcgggcgggagaccgttggcgccggcgcttcctcttaatcccggcttgttcccgacgcttgttcccgacggtgctcgctcctgggcccgtcctggcccgggctttctggccgatcgcgcaccccgtagtacccgcgcggcctagttctcgggggcttgggcacccgggtgctgtatcggcgggtttcttcccatctcctggacatttactttatatgctgcggcggaggtcgtacctccttggcctggaggaacccagtggggactgacgcagctccgggtgagctttggcggctgcgtcgagtgacaagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgtta

SEQ ID NO: 173922 - DNA, 2179 bp, Homo sapiens
  Payload ID: 14149
  Gene Symbol: RGPD5
  Gene Name: RANBP2-like and GRIP domain containing 5
  ENST ID: ENST00000413468
  CDS Start-End: 1-297
tactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagttaaattgaactattttttagacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatca

SEQ ID NO: 173923 - DNA, 541 bp, Homo sapiens
  Payload ID: 14149
  Gene Symbol: RGPD5
  Gene Name: RANBP2-like and GRIP domain containing 5
  ENST ID: ENST00000441344
  CDS Start-End: 86-541
gaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattg

SEQ ID NO: 173924 - DNA, 2848 bp, Homo sapiens
  Payload ID: 14150
  Gene Symbol: RGPD6
  Gene Name: RANBP2-like and GRIP domain containing 6
  Uniprot ID: Q99666
  ENST ID: ENST00000330331
  CDS Start-End: 78-2792
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 173925 - DNA, 7165 bp, Homo sapiens
  Payload ID: 14150
  Gene Symbol: RGPD6
  Gene Name: RANBP2-like and GRIP domain containing 6
  Uniprot ID: Q99666
  ENST ID: ENST00000329516
  CDS Start-End: 78-5375
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 173926 - DNA, 606 bp, Homo sapiens
  Payload ID: 14150
  Gene Symbol: RGPD6
  Gene Name: RANBP2-like and GRIP domain containing 6
  ENST ID: ENST00000437167
  CDS Start-End: 1-606
tttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaagggatttaattttagcctttttaaatctaatcccatggccttttggactagcaccccttcct

SEQ ID NO: 173927 - DNA, 568 bp, Homo sapiens; identical to SEQ ID NO: 173921
  Payload ID: 14150
  Gene Symbol: RGPD6
  Gene Name: RANBP2-like and GRIP domain containing 6
  ENST ID: ENST00000455695
  CDS Start-End: 399-568

SEQ ID NO: 173928 - DNA, 566 bp, Homo sapiens
  Payload ID: 14150
  Gene Symbol: RGPD6
  Gene Name: RANBP2-like and GRIP domain containing 6
  ENST ID: ENST00000446930
  CDS Start-End: 162-566
acagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaa

SEQ ID NO: 173929 - DNA, 2179 bp, Homo sapiens; identical to SEQ ID NO: 173922
  Payload ID: 14150
  Gene Symbol: RGPD6
  Gene Name: RANBP2-like and GRIP domain containing 6
  ENST ID: ENST00000484024
  CDS Start-End: 1-297

SEQ ID NO: 173930 - DNA, 5576 bp, Homo sapiens
  Payload ID: 14151
  Gene Symbol: RGPD8
  Gene Name: RANBP2-like and GRIP domain containing 8
  Uniprot ID: O14715
  ENST ID: ENST00000302558
  CDS Start-End: 193-5490
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttacaggctcaggatattaggggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgatggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaatcacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatccttcccgttcttctggatgagcatcctatcttcgtagttggtttggacttcgataggttgatggaaggaatacttctattaaccaaatagaatctgtttacaaaaa

SEQ ID NO: 173931 - DNA, 2848 bp, Homo sapiens
  Payload ID: 14151
  Gene Symbol: RGPD8
  Gene Name: RANBP2-like and GRIP domain containing 8
  ENST ID: ENST00000330575
  CDS Start-End: 78-2792
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 173932 - DNA, 5544 bp, Homo sapiens
  Payload ID: 14151
  Gene Symbol: RGPD8
  Gene Name: RANBP2-like and GRIP domain containing 8
  ENST ID: ENST00000409750
  CDS Start-End: 581-5458
ggcctagggggtgggggtgtgcctggatgtgtgttgcgggggtctgaacccttagttaggaccgggggccctcctttccacttcgtgcagtccctggggtctggggcatcctagccatgcgtggggcctccctgctgggattggagaccccctgacagctggggctggtcccagcattttcgctcttcccccagaaggactcagatgcagggtcttctctgctccccgtcacacagagggtggcacccccgatgggaactctcatttatcaccaaaccagaagataatggagaaactgacagagaagggctgcaagcagctaccgcagggcggtgtgtggatgcagatgggatgggcagatggaggcgggggccagcatcgctgccttcttgcccctcccagaggaccccaggtccccagctcgggcgccccaccagactgctttcattaaggttttctatagataagatcatgtcaagacaccctcagaccacagggcggcgccaccagcccggccgagtgcagctggagcgccgacgtccccgaggatacacagtgctgaggcagaacgcagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttacaggctcaggatattaggggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgatggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaatcacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatccttcccgttcttctggatgagcatcctatcttcgtagttggtttggacttcgataggttgatggaaggaatacttctattaaccaaatagaatctgtttacaaaaa

SEQ ID NO: 173933 - DNA, 2179 bp, Homo sapiens
  Payload ID: 14151
  Gene Symbol: RGPD8
  Gene Name: RANBP2-like and GRIP domain containing 8
  ENST ID: ENST00000522286
  CDS Start-End: 1-297
tactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagttaaattgaactattttttagacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatca

SEQ ID NO: 173934 - DNA, 541 bp, Homo sapiens; identical to SEQ ID NO: 173923
  Payload ID: 14151
  Gene Symbol: RGPD8
  Gene Name: RANBP2-like and GRIP domain containing 8
  ENST ID: ENST00000496537
  CDS Start-End: 86-541

SEQ ID NO: 173935 - DNA, 2511 bp, Homo sapiens
  Payload ID: 14152
  Gene Symbol: RBCK1
  Gene Name: RanBP-type and C3HC4-type zinc finger containing 1
  Uniprot ID: Q9BYM8
  ENST ID: ENST00000353660
  CDS Start-End: 569-1975
gcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 173936 - DNA, 2774 bp, Homo sapiens
  Payload ID: 14152
  Gene Symbol: RBCK1
  Gene Name: RanBP-type and C3HC4-type zinc finger containing 1
  Uniprot ID: Q9BYM8
  ENST ID: ENST00000356286
  CDS Start-End: 706-2238
cgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 173937 - DNA, 2208 bp, Homo sapiens
  Payload ID: 14152
  Gene Symbol: RBCK1
  Gene Name: RanBP-type and C3HC4-type zinc finger containing 1
  ENST ID: ENST00000382181
  CDS Start-End: 650-1672
ttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 173938 - DNA, 2752 bp, Homo sapiens
  Payload ID: 14152
  Gene Symbol: RBCK1
  Gene Name: RanBP-type and C3HC4-type zinc finger containing 1
  ENST ID: ENST00000382214
  CDS Start-End: 709-1719
ccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 173939 - DNA, 790 bp, Homo sapiens
  Payload ID: 14152
  Gene Symbol: RBCK1
  Gene Name: RanBP-type and C3HC4-type zinc finger containing 1
  ENST ID: ENST00000400247
  CDS Start-End: 397-588
ctggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 173940 - DNA, 961 bp, Homo sapiens
  Payload ID: 14152
  Gene Symbol: RBCK1
  Gene Name: RanBP-type and C3HC4-type zinc finger containing 1
  ENST ID: ENST00000441733
  CDS Start-End: 612-961
ggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatgg

SEQ ID NO: 173941 - DNA, 765 bp, Homo sapiens
  Payload ID: 14152
  Gene Symbol: RBCK1
  Gene Name: RanBP-type and C3HC4-type zinc finger containing 1
  ENST ID: ENST00000414880
  CDS Start-End: 1-765
aggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggagcaggggagagaagacagaagaggttggagaggtcagggaggtgccagatcatggaggccctcgtgtgctgccacgagttgattctaagagtagcgtggagccattggaggggcctaactggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgagg

SEQ ID NO: 173942 - DNA, 2613 bp, Homo sapiens
  Payload ID: 14152
  Gene Symbol: RBCK1
  Gene Name: RanBP-type and C3HC4-type zinc finger containing 1
  ENST ID: ENST00000415942
  CDS Start-End: 706-1524
cgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 173943 - DNA, 593 bp, Homo sapiens
  Payload ID: 14152
  Gene Symbol: RBCK1
  Gene Name: RanBP-type and C3HC4-type zinc finger containing 1
  ENST ID: ENST00000411647
  CDS Start-End: 242-593
gccggaggaggtgagggatgagattctgcaagtggagcccgcaggatctgctgatcgatgggacgaggaacgggagaaaaattaaagcggcgcatgaggcagacgaatgcaaacttcaccaatagctcaacgaaaagacagacggtgaccgctgagaggcagcgtcggatctgggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatg

SEQ ID NO: 173944 - DNA, 1200 bp, Homo sapiens
  Payload ID: 14152
  Gene Symbol: RBCK1
  Gene Name: RanBP-type and C3HC4-type zinc finger containing 1
  ENST ID: ENST00000475269
  CDS Start-End: 681-998
ggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcagattcctcatggtgcaaaatggccattccagctccatccagccatcacatcacaggaggaagggaagaaagacacccctccacactcttctaaagagcatagctcaaaaattgtacacacttcttccgttaattcctgtggaccagaactgattcccacagctacagttcagcttgaggggagactgtatagccaagatattcagctagaattcaggggttcgcttggtaagggaagggaagagaatggatactgtcggtctgtgctccaggagacttaaactcaatgctgaaacactttgcacaatgcctggcgtgttatgcactcaataataaacattagtgtctatcgtta

SEQ ID NO: 173945 - DNA, 6085 bp, Homo sapiens
  Payload ID: 14153
  Gene Symbol: RAPGEF1
  Gene Name: Rap guanine nucleotide exchange factor (GEF) 1
  Uniprot ID: Q13905
  ENST ID: ENST00000372189
  CDS Start-End: 125-3358
ccttttctgggcaccgccttctgctagggggttgtagatgaaagtgcctgctcccagagaagcttgtctaacctagcacagtttctaagctacccaggctgccagaccgagcgaccgtgctgccatggacacagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 173946 - DNA, 6045 bp, Homo sapiens
  Payload ID: 14153
  Gene Symbol: RAPGEF1
  Gene Name: Rap guanine nucleotide exchange factor (GEF) 1
  Uniprot ID: Q13905
  ENST ID: ENST00000372190
  CDS Start-End: 39-3326
ctggggctgggaagggccctgtgtcctctggctttaaaatgggcaatgctattgaaaaacagaagcccttgaaacgaagtcatctgtacccctggaaacaagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcc

SEQ ID NO: 173947 - DNA, 6256 bp, Homo sapiens
  Payload ID: 14153
  Gene Symbol: RAPGEF1
  Gene Name: Rap guanine nucleotide exchange factor (GEF) 1
  Uniprot ID: Q13905
  ENST ID: ENST00000372195
  CDS Start-End: 245-3529
cgctgcgctgcggccggctcgcgggccgggggagcggcggcgggcgcgcgggaggcggagcggcggcggcgggcgcggcgggagcggctgggcccgggcgggctggagcgcggtcgccgagcgcagggccgcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagaggcaacagacagatttctaccagagggctaccctctccccttggatctggagcagcaggcagtagaatttatgtccaccagtgctgtggcttccaggtctcaaaggcagaagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggagctggtcaggctcaccatcgagaagcagggacgtccgtctccgacgagccccgtgaagcccagttcccctgccagcaagcctgatggcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataatagtcctccaccagcattgccacccaagaaaagacagtcggcgccgtcccctacccgagtggctgtggtggcccccatgagccgagccaccagtggctccagtttgcctgttggaatcaataggcaggattttgatgttgactgttacgcacagaggcgactgtcaggaggcagccactcatatggtggagagtcgccccgcctctccccctgcagcagcataggcaagctcagcaagtcagacgagcagctgtcctctctggacagggacagtgggcagtgctcccggaacacaagctgtgaaacactagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcagacagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcagcatggaggttcctcagcccctgtcgaatttgtgggtgattttactgctcctgagtcaaccggtgacccagaaaaaccacctcctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctggagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactgggtccggtccataatcatgttacaggaaaaggcccaggacagggaacggctgctcttgaagttcatcaagatcatgaagcacttgcggaagctgaataacttcaactcctacttggccatcctctctgccctggactcggcgcccatccgcaggctggagtggcagaagcagacttcagagggcctggccgagtactgcacactgatcgacagctcgtcctccttccgagcctaccgggccgccctctcggaggtggaaccgccgtgcatcccgtacctggggctgatcctgcaggacctgaccttcgttcacctgggaaacccagactacatcgacgggaaagtgaacttctccaagcggtggcagcagttcaacatcctcgacagcatgcgctgcttccagcaggcgcactatgacatgcggaggaacgacgacattataaacttcttcaatgacttcagtgaccacctggctgaggaggccctatgggaactgtctctgaaaattaaacccaggaacataacaaggagaaaaacagaccgggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatcgctcgctgtgtgccttaaactccatctcatgtccctccccatcccctggctttccctccctccttgccccatcctgggccagccagcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcactgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtgtgggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgcca

SEQ ID NO: 173948 - DNA, 683 bp, Homo sapiens
  Payload ID: 14153
  Gene Symbol: RAPGEF1
  Gene Name: Rap guanine nucleotide exchange factor (GEF) 1
  ENST ID: ENST00000419442
  CDS Start-End: 1-683
ctctaccagagaagaaaaacaaacacatgctggcctacatgcagttgctggaggactactcggagccgcagccctctatgttctaccagacgccacagaacgagcacatctaccagcagaagaacaagctcctcatggaggtatacggcttcagcgactccttcagtggggtggactccgtgcaggagctggccccgccgcccgccctaccccccaagcagcggcagctgcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcgtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggagccaccggctgggaaagacggacatcccagagat

SEQ ID NO: 173949 - DNA, 957 bp, Homo sapiens
  Payload ID: 14153
  Gene Symbol: RAPGEF1
  Gene Name: Rap guanine nucleotide exchange factor (GEF) 1
  ENST ID: ENST00000414781
  CDS Start-End: 1-957
gctggccccgccgcccgccctaccccccaagcagcggcagctgagtgaaaacgccagtgaggaagctggtgagggtgaatatgtcaatctgtattcctctggccagagcagcgaggagctggctccctctcgaggagagccaccggctgggaaagacggacatcccagagatccctcagcggtcagcggcgtccctgggaaggacagcagagacggcagtgagagggccccaaagtcaccagatgctctggagtcggctcagtcggaggaggaagtggacgagctgtccctcattgaccacaacgaaattatgtccaggctgacgctcaagcaggagggtgatgacgggccggacgtccgcggaggatctggggacatcttactggtccatgctactgagactgacaggaaagatttggtgttgtactgcgaggcattcctgaccacctacaggaccttcatctccccagaggagctcatcaagaagctgcagtacagatatgagaaattctctccctttgccgacacattcaagaagcgcgtcagcaagaacacgttcttcgtgctggtacgggtggtggatgagctctgcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggccggggaccttgcacgactttcacagccatgagatagcggagcagctaacgctgctggatgctgagctcttctataaaatagagattcctgaggttttgctttgggcaaaagagcagaatgaggagaagagccccaacttgacccagttcacggagcacttcaacaacatgtcctactg

SEQ ID NO: 173950 - DNA, 588 bp, Homo sapiens
  Payload ID: 14153
  Gene Symbol: RAPGEF1
  Gene Name: Rap guanine nucleotide exchange factor (GEF) 1
  ENST ID: ENST00000438647
  CDS Start-End: 115-588
gcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaaaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacagctcagccctctcttcctgctatagccgagtgtaccaaagcctcgccaacctcattcgctggtctgaccaagtgatgctggaaggcgtgaactca

SEQ ID NO: 173951 - DNA, 6949 bp, Homo sapiens
  Payload ID: 14154
  Gene Symbol: RAPGEF2
  Gene Name: Rap guanine nucleotide exchange factor (GEF) 2
  Uniprot ID: Q9Y4G8
  ENST ID: ENST00000264431
  CDS Start-End: 420-4919
gtgttaagcctttttgaggggagtctgtgtgcagtcagccattttagcttttttcttttttttttttttttcctctccttttcttttgcctcttgttcttcaatctcagaaatgatcttgttctcttggaagactgagagctgtgtgaggttttctcagtcttgtcatagcctaggatggttagagtttcaatgttataaaaatggagacgaacactgttgttcggattccttttctggtctacaagtgtgaagggtttttaagcttaccagtagtgacactttaagctgcagcttggttttccctcctccctttttttttttcctttttcttttaatttaatgctgtagagggtgacttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctatattcttaa

SEQ ID NO: 173952 - DNA, 796 bp, Homo sapiens
  Payload ID: 14154
  Gene Symbol: RAPGEF2
  Gene Name: Rap guanine nucleotide exchange factor (GEF) 2
  ENST ID: ENST00000510253
  CDS Start-End: 1-796
aagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggtggcagtggcaatcagctgagatcttttggctccgggcagttggacttaaccagttcctcctcttctcttggaagctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtc

SEQ ID NO: 173953 - DNA, 582 bp, Homo sapiens
  Payload ID: 14154
  Gene Symbol: RAPGEF2
  Gene Name: Rap guanine nucleotide exchange factor (GEF) 2
  ENST ID: ENST00000511336
  CDS Start-End: 235-582
gatattatttggagtcagcaatcaatggattccatccctctgagacttgcttaacctacagctgctgatagaatacagcttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatgga

SEQ ID NO: 173954 - DNA, 723 bp, Homo sapiens
  Payload ID: 14154
  Gene Symbol: RAPGEF2
  Gene Name: Rap guanine nucleotide exchange factor (GEF) 2
  ENST ID: ENST00000512056
  CDS Start-End: 1-568
aaagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaagtaagcatctgcatatgtcttctgtgcattattttattttgttaaaatgatatgcaaagatagtgatgtaattaatgtttgcatgagtctgaaaactgttctaggtttttatgactgagctattttggaagcagtattaaacaatcaaatttgttttaa

SEQ ID NO: 173955 - DNA, 562 bp, Homo sapiens
  Payload ID: 14154
  Gene Symbol: RAPGEF2
  Gene Name: Rap guanine nucleotide exchange factor (GEF) 2
  ENST ID: ENST00000510510
  CDS Start-End: 96-562
agactacagtgtcttgctttctgcaggaagcagcaatgccgtttgtttcctaagaggaattttttatttagaaaaggaagctttctatccaggaaatggctttccttgtgcgttgctatgccaactgcctgcagccatggtcctccaaacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaag

SEQ ID NO: 173956 - DNA, 545 bp, Homo sapiens
  Payload ID: 14154
  Gene Symbol: RAPGEF2
  Gene Name: Rap guanine nucleotide exchange factor (GEF) 2
  ENST ID: ENST00000502485
  CDS Start-End: 1-545
agtagacgggctggtcaattttgagaagctaaggatgattgcaaaagaaattcgtcacgttggccgaatggcttcagtgaacatggaccctgccctcatgttcaggactcggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttg

SEQ ID NO: 173957 - DNA, 596 bp, Homo sapiens
  Payload ID: 14154
  Gene Symbol: RAPGEF2
  Gene Name: Rap guanine nucleotide exchange factor (GEF) 2
  ENST ID: ENST00000514565
  CDS Start-End: 135-596
gaacagcaatctgacgtctttagaggagacatcagttcattatgtggatacaaattctatgctttcggcttttatacaccaagtcttaatttaaatctgtttttcttgccttttctaacgaaagagactacatcatgcttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctgg

SEQ ID NO: 173958 - DNA, 838 bp, Homo sapiens
  Payload ID: 14154
  Gene Symbol: RAPGEF2
  Gene Name: Rap guanine nucleotide exchange factor (GEF) 2
  ENST ID: ENST00000505478
  CDS Start-End: 1-838
gataacagcttccgccaggcggtgatgaagaatccccccgaaaggaccccccaggatctggaaatagtatattcctatttacatggtatggaagccttatcaaacttgagggagcatcaacttaggttaatgtgtgaaactgtgagatatgagagacacgaagcaaatgaagttttatactaccctgatgatattgggacctgctggtatatccttctttctggttccgtgttcatcaaggaatccatgtttcttccaagaagcagttttggcaagcgttctgcaggaagttttaggcgtggctgtgaatgcattgttttagagccttctgaaatgattgtggtggactatatggatgaaaatgaagaatattttcagcggcaagcttcccatagacagtctcgaaggagatttagaaaaatcaaccagaaaggtgaaagacaaacaattattgacactgtggatccttatcccatgggcaaacctcctttgcctagaggctatcacacggaatgcactaaatctcagcttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattg

SEQ ID NO: 173959 - DNA, 970 bp, Homo sapiens
  Payload ID: 14154
  Gene Symbol: RAPGEF2
  Gene Name: Rap guanine nucleotide exchange factor (GEF) 2
  ENST ID: ENST00000505026
  CDS Start-End: 1-970
atcaaatgcatcttcgcagctttcttctcctcctacttctccacagagttctccaaggaaaggtggcagtggcaatcagctgagatcttttggctccgggcagttggacttaaccagttcctcctcttctcttggaagtgagaacagtaacaagaataacaatgcaccacggacctatgggataggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcatt

SEQ ID NO: 173960 - DNA, 3294 bp, Homo sapiens
  Payload ID: 14155
  Gene Symbol: RAPGEF3
  Gene Name: Rap guanine nucleotide exchange factor (GEF) 3
  Uniprot ID: O95398
  ENST ID: ENST00000389212
  CDS Start-End: 213-2984
gtgccagctggctccttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacacc

SEQ ID NO: 173961 - DNA, 4092 bp, Homo sapiens
  Payload ID: 14155
  Gene Symbol: RAPGEF3
  Gene Name: Rap guanine nucleotide exchange factor (GEF) 3
  Uniprot ID: O95398
  ENST ID: ENST00000395358
  CDS Start-End: 90-1886
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggtgtctgcctggccccagtttctttcctctgctcctcctggactgcaggcccctccttcgccccctgaccctgaggggctctgtgggcgtgggaagctctcctcccacagacacacccttgggtctctgataggtgttcacggggcccttgctgcatgtggtgccctgggccaggccgtgccaggaggcgcagaggcctaaggtggcctccctcctcgcccactccctgactcaatgggccttttattccttttgggaggtaattcatgcccacaggtagagcctgggagatgaggaatggtggctggagttggcccctgaggcccacggggctcctggtggccagtgctgtgggagctcagaggaaggcgaggcccctccctggaaagtcagagggggccccaggccattctcagctggggcttaaagggaagcaaagaggggatgagaagatgtgactgcagccaggatttggttgaggaatggtgggagaaagaactggaaaggtagattaggttggtggtggggagggctgcactgggaataaaatccaggggcctcaccatccagcaggctccccatggtcccaccctactgtgtgtcccagcccctgcctgctggagactcttactggcttcttctcctccgcaggcgaagcccgttctcccctcagggcctttgcacttatcccttagcctggaagggtctttctctggctctgcctggcaggatccttctcgttctcatctcagccaaatgctgggttcccagacaggccccctcccgtctccctatccggagcaccctcccctttctcccaccacgctctgccttggtgtcctctgtgattttcttcaaagcactctcgccatgtggagttgttttctttgcctacttgctttctgtcctttggtatctctcccatcccactggagagttgacttccctcctgcgggcccccacctccgcttctccttgctcacatgctgcctggctcttggctgacgctcagaaactgatgtgggctcaccctcgcaggccgggcactgcgctaggtgctgatgctgcacctcattcaaccctggcctgtggggctgcagtcaggcaaggggcagagcagttcaacaacccgtgatgtgcagtgacacgggacactttccctgaatgtgcactggagtcggctcttccaactgtagtccgctcctgaaaacgggaggggaagagccaactccagtgcagattcagggaaagtgtcccgtgtaagcgactactggagttgagagctgcagggggcaagggtggaggaagaagaggattcctggtgggcaaacccaggaggaaagggaacccaggaggaggatccctggaggagcgagagtaagagtaggaccccagagcaggcaggaggtgggcagggccccctgggccaaggacaggggtctgatctttgtcctaagagcagtgcaaaccattaaaggggtttgagccaaggttggcaaagtctgatttgtgttttgaataggtcagctaaagagcctgggctttctccagcagacaatggacgccactgaagtcgagtgcgggagcttcacagggctctggtcaggcagattggaggaggagggctggaggcacctgggagggaggaggaggagcatagttgggccattggagtagataaggagtgaggcctcgtgggcaggtggaactggagttagcctgggcaggggaggagggggcacagaagacccacttcaaagaagaatcttcaaagcaagatgacaagctacggaagtgtggaggagcctggagctggggagaatggctggggaacagagtggtctgggaggcaggatgcaaggatccgatgggtatatggagtgtgaggtaatggatcattcatgtggaaggatgcagggggtttttgagaccagggtttggaagagagttcagcactgctggtagttttgggaatcacccatgtgcaggcgacacatgaggcagtaaggaactctgcaggggtccctgagatttggaaatgtagggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaa

SEQ ID NO: 173962 - DNA, 5751 bp, Homo sapiens
  Payload ID: 14155
  Gene Symbol: RAPGEF3
  Gene Name: Rap guanine nucleotide exchange factor (GEF) 3
  Uniprot ID: O95398
  ENST ID: ENST00000405493
  CDS Start-End: 211-2856
gttagtcagggctgaggaggagaggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttg

SEQ ID NO: 173963 - DNA, 6061 bp, Homo sapiens
  Payload ID: 14155
  Gene Symbol: RAPGEF3
  Gene Name: Rap guanine nucleotide exchange factor (GEF) 3
  Uniprot ID: O95398
  ENST ID: ENST00000449771
  CDS Start-End: 90-2861
ggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaactgacagcttcttcccaactgcaatccccgcttttccacacttgagctcgtcctggcctgttgggccaggcttctggggtcttctgggggtggcttgtgatagaaacaatgctgaagcttccgcggagagcccgtcgcttgttgaggcccaacagacttccaggaaatcagggtttatcatcagtgttgagaatggtcccagcaagctctggtcatacgaagtcctctcttccctgccccttcagcacttcccctaggaaccagctactgccaggacgcctcttgcgaggcagagctcacccaggaagctccagggactccaccctcttgccttgctattgccctgagtcctggcagcaggaggcacttgtctggccagagagagaactcatggcccctggcatgactcctgagtaggtattgaggctgcagggccttgggcgtccagaggcagctggtatggcccctctgcacttcagccccatggatgtggatacacaggcctgctgcttccagaaagggtcagagcctttagcagggaggcagcacagctgggcttagacctcaggtcactaagtgaatctgagcaagtcagtgaacagttctcttccttcatttctccacctgtaagccaggtatgataaacgccatacagcgcttagtgacaaacacataaaactgtagctcctgcctctgtagcagaggtgacagccaagggcagtcctgtgctatccaggcctggtaggggggcagcctcgcctcagttgagggctgagggagagactgaggtgcagcagatggcagtggtaaccaaaccagttcccttgccgtgggtggggacacaggagaagcacggaagcatctggaactgagcaatcaggacaggaggctcaagcctgggtgagtcaggagtccgggggctttcttttcatccaacccattgtctgctggtgtctcggcaaaagccagccagccagccgtggcccttcaccgttcttcagactctagggtgagcccagcccagcgacacaacagaaaccaagtgccacgggggccggtgtcctccaccagcatttctcctctggtcacatctacgtcctgatgggacttctccctcctccttggaccatcagctttacagtccagaccaccctgcagccacccggtggtctcccagctgccccagtctcgggcaggatggcttttgagcctgttgggagagaccttgccaggagaatggtgcccagggcaggcaagaggacacagactctgggagctagaagagttgcggcccagggggccaggccactcccagaggacaggaggcccaaaagcggggaaaggctccatgttacggtggccccatgctgggagtttgtgctgccttctgtctccctgactgcccaagcgtggggtggtgtggggcaggaggcatcctctggtgttccctagcagcccaggctgtgtgcaggggctcccattttgtgtctcagctgcaagaaggccacaaagggaggaggggctcatgggactgctgagaagaaggtgtgcagaaagggagtgtggccctagatcagtcctttaaaaagcctctgttacctgaaaggaggtcaagcagagaggaatggctgcgtgtgtgtcctaccgggcaggacaggacagagggaggtcattgttacacacacatcccccctcctttcctccttcccctccacttccctgtgaaggcctgaggcaggctgtggccaggctcaggccctgactgtggggtacacaccagggagggccacgcctccccacagacggggtggagtggtcagtggagccagcaccctctgctgcttcagcatctccgcctggagccagctgtcccctctctctcaggctccatccgaacaaaaggaaggcagagcctgagatccggcaccccatccccctccactcagcactgagttagagctgggtgggggcatgtctgccttcacacgctgccttatggcttctgtgtctccaacagccctcagcctctggctgctctccttcccaatagtcacaagatttaccatgataataataggttaagacttgaatggtgttttcatcttctttcatcttcaccctgtctcacgttacgttatttttatcctgatgacagaataggtactacaggtatttttactctggttttacagtcaaagaaactgaggcacaggcaggtttgcccaaggtcacataactgcttaatagcagggtagacaggtgaagtaactggatgtgtatcagccatgccctttccccatgcccccggcactccccatgacagctctctgaatcccaacattttattcttttgcaggattagacccaagcatataaattcctttttccctctc

SEQ ID NO: 173964 - DNA, 855 bp, Homo sapiens
  Payload ID: 14155
  Gene Symbol: RAPGEF3
  Gene Name: Rap guanine nucleotide exchange factor (GEF) 3
  ENST ID: ENST00000466322
  CDS Start-End: 188-855
ggagaagggtttaagccgaagctgcatttctgggagacctagtgaatctatagcttcatactgggaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaacc

SEQ ID NO: 173965 - DNA, 695 bp, Homo sapiens
  Payload ID: 14155
  Gene Symbol: RAPGEF3
  Gene Name: Rap guanine nucleotide exchange factor (GEF) 3
  ENST ID: ENST00000548434
  CDS Start-End: 1-554
atgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctgtgctaatgggaggttggaagccccgtgttcgcctgtgacagagcctgggatccctcatggaaccaccgggtataccgactggccctcgccaagctctcccctcctgtcatccccttcatgccccttcttctcaaagacatgaccttc

SEQ ID NO: 173966 - DNA, 2776 bp, Homo sapiens
  Payload ID: 14155
  Gene Symbol: RAPGEF3
  Gene Name: Rap guanine nucleotide exchange factor (GEF) 3
  ENST ID: ENST00000548919
  CDS Start-End: 305-2749
tcctttaggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagca

SEQ ID NO: 173967 - DNA, 3265 bp, Homo sapiens
  Payload ID: 14155
  Gene Symbol: RAPGEF3
  Gene Name: Rap guanine nucleotide exchange factor (GEF) 3
  Uniprot ID: O95398
  ENST ID: ENST00000549151
  CDS Start-End: 299-2944
aggagctgccggtggagagtgagtgctggtcctgtggaggagggagcaagccccgtggtccggagtgcatttccatggatggcttcagagctggccaggatggacagtactccaggcagtgggaaccgcacgtgtgatggcgcagagggaagaaataaagcggccgctttgggaaactgtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttcc

SEQ ID NO: 173968 - DNA, 648 bp, Homo sapiens
  Payload ID: 14155
  Gene Symbol: RAPGEF3
  Gene Name: Rap guanine nucleotide exchange factor (GEF) 3
  ENST ID: ENST00000495953
  CDS Start-End: 226-648
agtccagaggactctaaggaagtagttctgcctggggcagttgtactgtggcccagccgccccagtcgtgtcccatggctgtccactttcctccccgtgtcacaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccgg

SEQ ID NO: 173969 - DNA, 910 bp, Homo sapiens
  Payload ID: 14155
  Gene Symbol: RAPGEF3
  Gene Name: Rap guanine nucleotide exchange factor (GEF) 3
  ENST ID: ENST00000495465
  CDS Start-End: 1-327
ttccccgggcccgagcccgagcccgtgagaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgtccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagctt

SEQ ID NO: 173970 - DNA, 2659 bp, Homo sapiens
  Payload ID: 14155
  Gene Symbol: RAPGEF3
  Gene Name: Rap guanine nucleotide exchange factor (GEF) 3
  ENST ID: ENST00000547856
  CDS Start-End: 17-256
gagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggcccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccag

SEQ ID NO: 173971 - DNA, 4299 bp, Homo sapiens
  Payload ID: 14156
  Gene Symbol: RAPGEF4
  Gene Name: Rap guanine nucleotide exchange factor (GEF) 4
  Uniprot ID: Q8WZA2
  ENST ID: ENST00000397081
  CDS Start-End: 144-3179
gggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 173972 - DNA, 649 bp, Homo sapiens
  Payload ID: 14156
  Gene Symbol: RAPGEF4
  Gene Name: Rap guanine nucleotide exchange factor (GEF) 4
  ENST ID: ENST00000397085
  CDS Start-End: 1-564
ctgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatggtatgtgcagtattataaccttaaccacaatgtgtttttaaaataaaatttgcattttttctaataaaggaaataatttccatatatgctgccctgctaaaaa

SEQ ID NO: 173973 - DNA, 4120 bp, Homo sapiens
  Payload ID: 14156
  Gene Symbol: RAPGEF4
  Gene Name: Rap guanine nucleotide exchange factor (GEF) 4
  Uniprot ID: Q8WZA2
  ENST ID: ENST00000397087
  CDS Start-End: 391-2994
acagttctgattcttttaaaccaagcggaagcctgcttcgatgacttggacttatgtctgcaccagggtctcattcctgtgtcttcaagcttttccatggagtggcaaaatgattcaaatccagaaaggaagggagtgaagttattaggagctaactaaagttaaaaaaaaaaaaaaaaaaaaaaaaggaagtgttttcttattgccttagactgcctgagctttcctggagaaccatcagcaccagtttcctttctgtggactgagagccactcagtagtagacacgaacagggaatgaacggcaatgaaggtacattttgctgatcaaataaaggatagatgctcactggatgtctgagaactttgagagaccgaaaaagaaggacgtatgctctacaagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 173974 - DNA, 3975 bp, Homo sapiens
  Payload ID: 14156
  Gene Symbol: RAPGEF4
  Gene Name: Rap guanine nucleotide exchange factor (GEF) 4
  ENST ID: ENST00000409036
  CDS Start-End: 18-2849
gcgcgccgccgctcaacatggtcgctgcgcacgctgcccattcttcctcctctgccgagtggatcgcctgcctggataaaagaccactggagcgatccagcgaagatgtggatataatcttcactcgactgaaagaagttaaagcttttgagaaatttcacccaaatctccttcatcagatttgcttatgtggttattatgagaatctggaaaagggaataacattatttcgccagggtgatattggaacaaactggtatgctgtcctggcagggtctttggatgttaaagtatctgagaccagcagtcaccaggatgctgtgaccatctgtaccctgggaattgggacggcctttggagagtccattctggacaacacaccccgccatgcaaccatcgttaccagggagagcagtgaactgctccgcatcgagcagaaggacttcaaggcactatgggagaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgacaagaaa

SEQ ID NO: 173975 - DNA, 3707 bp, Homo sapiens
  Payload ID: 14156
  Gene Symbol: RAPGEF4
  Gene Name: Rap guanine nucleotide exchange factor (GEF) 4
  ENST ID: ENST00000535187
  CDS Start-End: 212-2587
aaatgtttgtttttgtacttgtgagttatgcattttatggggcagactgtcgttgctgaatttctttctgctttttattccatctgttcctcaactcttacaaaagctagccataccatctctctctctagcttctgaagtggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 173976 - DNA, 3920 bp, Homo sapiens
  Payload ID: 14156
  Gene Symbol: RAPGEF4
  Gene Name: Rap guanine nucleotide exchange factor (GEF) 4
  Uniprot ID: Q8WZA2
  ENST ID: ENST00000538974
  CDS Start-End: 278-2800
aatttagattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacgtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 173977 - DNA, 3974 bp, Homo sapiens
  Payload ID: 14156
  Gene Symbol: RAPGEF4
  Gene Name: Rap guanine nucleotide exchange factor (GEF) 4
  Uniprot ID: Q8WZA2
  ENST ID: ENST00000540783
  CDS Start-End: 278-2854
aatttagattaccaatgataaagccggggctacggctaaagaaaggtaggatgcatacgcagaaacattagtgctaatatgctgcagaaaagccaagataaatcagtccagctctcatacatcactaagggagaagctgattgcaacttgaccatgttgcctgagtagtcccatcagtgagaagaggagaacatggatttaaaaaaaactagaatgtacccctagggctcctgccgtggtggacctgggagaagtgtctggtaaatatcgacagtatatggcaggacttctggctcctccttatggtgttatggaaacgggctctaacaatgacaggattcctgacaaggagaacacacctctcattgaacctcacgttcctcttcgtcctgctaacaccattaccaaggtcccttcagagaagatcctcagagctggaaaaattttacgaaatgccattctctctcgagcacctcacatgataagagatagaaaataccacctaaagacatacagacaatgctgtgtgggaactgaactggtggactggatgatgcagcagacaccatgtgttcactcccggactcaagctgttggcatgtggcaagtcctgttagaagatggtgttctcaaccacgtggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtcttacgagaagataactgccatttcttaagagtagacaaggaggatttcaaccggatcctaagggacgtggaggcgaatacagtcagacttaaagaacatgaccaagatgtcttggtgctggagaaggtcccagcagggaacagagcttctaatcaaggaaactcacagcctcagcaaaagtatactgtgatgtcaggaacacctgaaaaaattttagagcattttctagaaacaatacgccttgaggcaactttaaatgaagcaacagattctgttttaaatgactttattatgatgcactgtgtttttatgccaaatacccagctttgcccggcactggtggcccactaccacgcacagccttcacaaggtacagaacaggagaaaatggattatgccctcaacaataagaggcgagtcatccgcctggttctacagtgggctgccatgtatggagacctcctgcaagaggatgacgtgtctatggccttcctggaggagttttatgtatctgtatcagatgatgcccggatgattgctgccctcaaggagcaactgccagagttggagaagattgtcaagcaaatctcagaagatgcaaaggcaccacaaaagaagcacaaggttcttttgcaacagttcaatacgggcgatgagagagcccagaagcgccagcctatccgcggctctgatgaagttctgtttaaggtctattgcatggaccacacctacacaaccattcgggtgccagtggccacttcggtgaaggaagtcatcagtgcagttgccgacaagctgggctccggggagggcctgatcatagtcaagatgagttccggaggagaaaaggtggtgctcaaacctaatgatgtttcagtatttacgacgctcaccattaatggacgcctgtttgcttgcccgcgagagcaattcgattcactgactcccttaccagaacaggaaggcccaactgttggaacagtgggaacttttgaactgatgagctccaaagatttagcataccagatgacaatttatgattgggaactcttcaactgcgtgcatgagctggagctaatctatcacacatttggaaggcataattttaaaaagaccacagcaaacttggatttgttcctgaggagatttaatgaaattcagttttgggtcgtcactgagatctgcctttgttctcagctcagcaagcgtgttcagctattaaaaaaatttattaagatagcagcccactgtaaggagtataaaaatctgaattccttttttgccatcgtcatgggactaagtaacgttgctgtgagccgcttggcactaacgtgggagaaactgccaagcaagttcaagaagttctatgcggagtttgaaagtttaatggacccttcaaggaaccacagggcctacaggctgacagtagctaagctggaacctcctctcatccccttcatgcctttgctcattaaagatatgacatttactcatgaggggaacaagacgttcattgacaatctagtaaactttgaaaaaatgcgcatgattgcaaatacggccagaacagtgagatactacaggagccaacccttcaatcctgatgcagctcaagctaataagaaccatcaggatgtccggagttatgtacggcaattaaatgtgattgacaaccagagaactttatcacagatgtcacacagattagagcctcgtcgaccatagacatttcaaatgcccaaagcaacagtttgtctccagtccacaatctttcaaaaatgccatttatgctactactgactgtattgccactagagaattctacaaaacaagcaaaaacacatcctgagacacctcagggctgcattcagcttaccagctacctagcaagagaaggaattatttgacatgcctaaagcttacacactctagcttaggaatccccagtttgtggctaccctgtttcatttccacttgtgccatcttctttgctgaagtgttgaataaggcccacgtgaagagtttggtagaaatagccttgtcaagagaactagcaagcccctgacatttttttctaagagtgtttatgggatgagatgtgctacaaatgggatagatttggataaaattttaactcaacatcttgatttggagcctggggtttcgggaaggtgttgaggaatctatagaagtccaaattataggttgtattcttccatcttcattgtcttacctctgaaggaatagaacctgaccacattattatgaaacattatggctgtttatgtaatttagggaggactggtctgtaatttctgaatgtatatagaataatatttatgtttacaatgtaacttttcaaaatttacaaatcaggattatatacataagaattccactaagaaatgccaagattcttaaatttgccagcgttaaagtagaaaataacatttcagaagagcacaatatgcataaaacatttttcaaaattgaaatattttcctgggcattaaaaacctttactattggctacaaatttattgtacctgatgaaaacatattttctggacttaaatgttattacaaatatcttaattttcagtaattgttttgcactttcaaagattgtaaatagttcattcaatcaatggtatggagttatttatttgctacataatagatactgtgccaaataattactttttatttattttatttagtacgtaattttgaagtacattttttcctgttttcacaattagactacatttaatgtgtaggaattgtatgtatgtatatcttctgtaaataacatctagtatcttcactaaatataattgtcgac

SEQ ID NO: 173978 - DNA, 6621 bp, Homo sapiens
  Payload ID: 14157
  Gene Symbol: RAPGEF5
  Gene Name: Rap guanine nucleotide exchange factor (GEF) 5
  ENST ID: ENST00000344041
  CDS Start-End: 314-2506
gctgcggccgcggctgagggacctgcccgcgctgctgcggagcgggctcacgctgcggaggaagcggagcgccgctgggggccggactctatcaagaagaatatctaatccgtaccttgaacatacgccttcccagatttatggagagaattcttcttgtgcaggaagagcattgaggaatattattatcgttcaagcagctgacctgataaaggacagagtgaacctcaaggggttttacaggaggagctgcgttgggtcagagctggtagactggcttctagaacactgtcctttcgtccagtgcagatctatggccataggagtctggcaactcctactggacatgggaattatgttatcagtggaccagcatctatactttcaagatacttatgttttctaccagttttcctctgatgaatgtagctacttgtactgtgaatttgaaagagaagaagaatggcaaaatggtgtcaagcttttactgcaacttgtgcctctcattcctgccagaggtggcatctgtgaactgtctcatcagaaaattgaagactccgaagaaagcagtgatgaaattcttgtgcgtctaacatctgcggtgcagagagagctagcagctgttattgctttgaaagcaaggaagtctgcaattgaacaagatgaagaaaacaacgacaaacatgtagctgtaacagaagccgaaagtgttccagattctcaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgcctctt

SEQ ID NO: 173979 - DNA, 6159 bp, Homo sapiens
  Payload ID: 14157
  Gene Symbol: RAPGEF5
  Gene Name: Rap guanine nucleotide exchange factor (GEF) 5
  Uniprot ID: Q92565
  ENST ID: ENST00000401957
  CDS Start-End: 249-1991
agtttccctgcagccacagaggcacgcgctcccgtttccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgcctcttagtttcttgctttctctgtgatgtgtgtggattaaatagctctgttctggcag

SEQ ID NO: 173980 - DNA, 2800 bp, Homo sapiens
  Payload ID: 14157
  Gene Symbol: RAPGEF5
  Gene Name: Rap guanine nucleotide exchange factor (GEF) 5
  ENST ID: ENST00000405243
  CDS Start-End: 85-1287
tctcgcttcctggcgaaggcgcggacggcgcgcggaggcgagcgcggtggagaggagcccccggcgccgcagcgccgtcagggcatgaggatggccgtgggctccgtcaagatgcagccgccgtgcgagagcccggccctggccgccgcggcggcggtggtggcggcagacggccccctgcgccgcagccccagcgcccgggagcccgagcgcgagcagccgccggcgtcgctgcggccgcggctgagggacctgcccgcgctgctgcggagcgggctcacgctgcggaggaagcggagcgccgctgggggccggactctatcaagaagaatatctaatccgtaccttgaacatacgccttcccagatttatggagagaattcttcttgtgcaggaagagcattgaggaatattattatcgttcaagcagctgacctgataaaggacagagtgaacctcaaggggttttacaggaggagctgcgttgggtcagagctggtagactggcttctagaacactgtcctttcgtccagtgcagatctatggccataggagtctggcaactcctactggacatgggaattatgttatcagtggaccagcatctatactttcaagatacttatgttttctaccagttttcctctgatgaatgtagctacttgtactgtgaatttgaaagagaagaagaatggcaaaatggtgtcaagcttttactgcaacttgtgcctctcattcctgccagaggtggcatctgtgaactgtctcatcagaaaattgaagactccgaagaaagcagtgatgaaattcttgtgcgtctaacatctgcggtgcagagagagctagcagctgttattgctttgaaagcaaggaagtctgcaattgaacaagatgaagaaaacaacgacaaacatgtagctgtaacagaagccgaaagtgttccagattctcaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacaggtaaggctctgagtagctcatgcttccagactgatagcagctgatgcccttgtcagtaccctcaggggcaaggttcccactgttagctgaaaccggggtggggagaaatagcatatgctttgtgcgactcgtcccttgccttgtgctgatttgtttaaatccaataaatggacacatgtagatcccaagcagctccctgggaagtagctgtacaaagaaaatgatatgaaggcagctgttcttgtttctttggcaatttttcccaaatctcacctaaaggcagttggcaagagaccaacattcaatagcccatgttcaatggaaagaaatacaaggaggaggagggttagcaggcgttcacctggcatgtaggcagtgctgagctgggggcagcagcctccgtgctgaaatgtcaacaattaatgcaactactcagcagctacatgcttagtggcaacttctgcctttttccaagtggtttacaaactgcctggtcagaacaagccccgaggtgcagactatgatactcacagcttttcagagcagaaactgtaatgcactaaagccttatcgatcagacttcttgtattttaaatttaatctgagagtaaaacactcattttgctttttcacccatacacttttggaaacactactgttccacttacaaaatgacttacctgtaacttcctttatctcagaagggagagtacttgcttctcttaaccagaatttgtaatttgttccatgctggagcagttattccaatgaataggcctctgactgtagcctgcattttgcaacttgatcccttaactaaaatgcactgtttgctcctaccatagcacctgtgagacccacagtttccttaggtttttaccatgcaagaaggattgtgaaatgacagcttaggtgggaacaagaatttccttgtgtccctggagttttgtctgaacataggtgatgtctgggtctattttgcattctaaaggacaataagagaaacaagtatgtgtgaaatacataagtgggcaaaaaaacagtatcaaaatgacctaatcatgtatcctacagtaaagttattgtgtaattttaaaattcagatagataccttattttgcatatgtttgaagacaaaatcagtagttgtcatttatatgcactaaataaacagctaaaagaaaaacata

SEQ ID NO: 173981 - DNA, 660 bp, Homo sapiens
  Payload ID: 14157
  Gene Symbol: RAPGEF5
  Gene Name: Rap guanine nucleotide exchange factor (GEF) 5
  ENST ID: ENST00000420196
  CDS Start-End: 194-660
agtttgctctgtccttcaccctcttaaagtagggtgatacgcagactcaactttaagtcttttggcatggtgctcttaggttataataatgtaacttcaatttttgaaaggcaaaatattttaccaagaccatgatttaatccaggcagtggaaaagatgagcttattataaggtgaactttgcggtggtgtcatgtcctgggactgtggttttaagtatatcttcgctttttctccaactcttaaggcaggggtgatgtgcaagctccaggaaagagatgaaatcggacgaattgaactagtccagaagctggcaaaagaaaactatcagtttttgcagacggacaaaaaagaacaggagaagtctgaacaccaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggca

SEQ ID NO: 173982 - DNA, 836 bp, Homo sapiens
  Payload ID: 14157
  Gene Symbol: RAPGEF5
  Gene Name: Rap guanine nucleotide exchange factor (GEF) 5
  ENST ID: ENST00000451559
  CDS Start-End: 84-458
gatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagttataccaacccctgggatcacatgtgtcacttctgccatgtgctcacaaagccaagcggaccaggacttcatggcttgactctcctagcaccaacctaagtggggaagaagggagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcacca

SEQ ID NO: 173983 - DNA, 869 bp, Homo sapiens
  Payload ID: 14157
  Gene Symbol: RAPGEF5
  Gene Name: Rap guanine nucleotide exchange factor (GEF) 5
  ENST ID: ENST00000458533
  CDS Start-End: 444-869
gtgttcagccatctctcctttttaaaaagggactgaggtgaagaaagtctgtgcagtcatccatggcatccgaatttcagcctagatgagattctaactagagatccatttttgcttatattctggcaaaactagtacattataaatttgaaggccatctcaagtctgaaaaaaaaattgaattgaatgatggacaagatgatgaagtgacgactgttcaggttaaagagcaagaccagagcgtcctggtgctgaagaaagtgcagtgctgtggcccagcccccacagctgggagtgcggagagccattggagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctat

SEQ ID NO: 173984 - DNA, 5506 bp, Homo sapiens
  Payload ID: 14157
  Gene Symbol: RAPGEF5
  Gene Name: Rap guanine nucleotide exchange factor (GEF) 5
  Uniprot ID: Q92565
  ENST ID: ENST00000620335
  CDS Start-End: 75-1409
agttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaag

SEQ ID NO: 173985 - DNA, 5618 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000296859
  CDS Start-End: 82-4911
ggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagg

SEQ ID NO: 173986 - DNA, 4176 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000308008
  CDS Start-End: 1-4176
atgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctga

SEQ ID NO: 173987 - DNA, 8357 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000509018
  CDS Start-End: 207-5012
cccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctgcatatcccccttcattttaaaatcatgaatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttggggagaaaaagcctttagtgaattttcttgagggtgataaatcacatcattgcgatctatatcacctccttgagaatctctcccaggctgaaaatgtgatggtaatcatgggtgtttttaagaacaaatctaatttttatcaagtgttctttcctctacaaaaaaggaaggaggagaaaaagcttccttaaaactgattattttgattcaattttaagtttctaaaaaaggtgatattaaagtatatgtattccttcagcattaccttaaaggctagaaaaacgggataaatcttcagaaaagtgtcaaaagtgtcacagtacatgttcaaatttaaacttgaatcctggttcatctttgacttttgttgtgcatttttaatgcttctttatttttgatacacagaatgcagttgaacttgatcttttaaaattgagacatgtaagctaatcagcaaaagacagaaacaaaactgcacatctgtaataatcagatagcaattctactgcacaattcattgattgtaaggtatcctgtaacaagcaatgtttgtctcctattttttgatacctcttaaacttatgtcttttagaaagacagtgcctctgtatgctttttgtatttttactgagtgtaaatatttgttatatttttggttaagagaatgtaaaaataccatttattattatcatatctactaatacattggtggaatcaataaagaatctacattaa

SEQ ID NO: 173988 - DNA, 560 bp, Homo sapiens
  Payload ID: 14158
  Gene Symbol: RAPGEF6
  Gene Name: Rap guanine nucleotide exchange factor (GEF) 6
  ENST ID: ENST00000513227
  CDS Start-End: 94-560
attagatatttcatcttactgcagagcatagaatcaataggagcttctccttagggagctgctttgaaacagcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaat

SEQ ID NO: 173989 - DNA, 3107 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000510071
  CDS Start-End: 202-2685
gcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtgaataagcttattagtggatgtgcttatttgtagatgtgcttttgaagatttcctgttaaaacagctattgtaagtagaaacattatcatgttttagtgctcctaaattcactccagaagacgcttgataaaatatcttgtcactcctgctaaaataaactcttagaaccactgatataatctagttcctgtttttttatagaggaagctgaatgatacaaatcttcatatatatctgaatgactgtatctactaatttataaatttgtttttaatatggccagtatgtactttggcaaaagaagccatggttttcacagttctttttctaagtagttttcctttaatgaatatgcaggaaaattttaaaaattttaaaatgtgttctgaaaattatttaataaactagattatttctgtagta

SEQ ID NO: 173990 - DNA, 4103 bp, Homo sapiens
  Payload ID: 14158
  Gene Symbol: RAPGEF6
  Gene Name: Rap guanine nucleotide exchange factor (GEF) 6
  ENST ID: ENST00000515170
  CDS Start-End: 184-3798
agtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgatgtgaatttagtgctcttgaaaagggctggactggcagccctgcagcctcttcccgtatacccacagcacagatgcaccacagatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcag

SEQ ID NO: 173991 - DNA, 552 bp, Homo sapiens
  Payload ID: 14158
  Gene Symbol: RAPGEF6
  Gene Name: Rap guanine nucleotide exchange factor (GEF) 6
  ENST ID: ENST00000504575
  CDS Start-End: 86-552
atagaatcaataggagcttctccttagggagctgctttgaaacagctctggtttgaaaaggaaactaccctttccagcctaggaaatggcttttcttgttcgctgttatgccaattgtcttcagccatgggcctccaaacttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagca

SEQ ID NO: 173992 - DNA, 5742 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000507093
  CDS Start-End: 183-4712
gtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagctgttggtttttattatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcc

SEQ ID NO: 173993 - DNA, 3535 bp, Homo sapiens
  Payload ID: 14158
  Gene Symbol: RAPGEF6
  Gene Name: Rap guanine nucleotide exchange factor (GEF) 6
  ENST ID: ENST00000512052
  CDS Start-End: 1-3345
atgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctgatgaagttccttatttaattttagtgttaagtttgttttcagttattaatgtatacatggcttaaattaaaccatttgtcaaagcttaggcagacaacttagtaaaatactatttataaacacttgaaaatgcctcatttgtacataagttattttactgatgtattgagttagtaaattttatactcttg

SEQ ID NO: 173994 - DNA, 542 bp, Homo sapiens
  Payload ID: 14158
  Gene Symbol: RAPGEF6
  Gene Name: Rap guanine nucleotide exchange factor (GEF) 6
  ENST ID: ENST00000504039
  CDS Start-End: 94-542
tgatttgtaaaaagaaacttaacagaattttatcaccgtactcatcactgtagctctggtttgaaaaggaaactaccctttccagcctaggaaatggcttttcttgttcgctgttatgccaattgtcttcagccatgggcctccaaacttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgat

SEQ ID NO: 173995 - DNA, 4694 bp, Homo sapiens
  Payload ID: 14158
  Gene Symbol: RAPGEF6
  Gene Name: Rap guanine nucleotide exchange factor (GEF) 6
  Uniprot ID: Q8TEU7
  ENST ID: ENST00000627212
  CDS Start-End: 130-4644
gttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggca

SEQ ID NO: 173996 - DNA, 3429 bp, Homo sapiens
  Payload ID: 14159
  Gene Symbol: RAPGEFL1
  Gene Name: Rap guanine nucleotide exchange factor (GEF)-like 1
  Uniprot ID: Q9UHV5
  ENST ID: ENST00000264644
  CDS Start-End: 191-1561
agaaggaagataaactccacatatttctgtgagtatgagaaaggtgcacactcttgggttcagcaatctgtaggcctgacttgggtacacagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccacctctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaacctgcc

SEQ ID NO: 173997 - DNA, 1582 bp, Homo sapiens
  Payload ID: 14159
  Gene Symbol: RAPGEFL1
  Gene Name: Rap guanine nucleotide exchange factor (GEF)-like 1
  Uniprot ID: Q9UHV5
  ENST ID: ENST00000456989
  CDS Start-End: 47-1582
attgtgccctaccagagaggacagatgggcaccgcctccagtggcaatgctaattcacccaagaggccttcccagctcttctcacagaaggaagataaactccacatatttctatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtga

SEQ ID NO: 173998 - DNA, 2079 bp, Homo sapiens
  Payload ID: 14159
  Gene Symbol: RAPGEFL1
  Gene Name: Rap guanine nucleotide exchange factor (GEF)-like 1
  ENST ID: ENST00000544503
  CDS Start-End: 160-1677
cttcccagctcttctcacagaaggaagataaactccacatatttctgtgagtatgagaaaggtgcacactcttgggttcagcaatctgtaggcctgacttgggtacacaggtaggtgagtgaaggtgtccaggccacagacctgtcctgactctttgaaatgatgctgagacccggttatcccttgagccaggaatccttccccattgatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagctt

SEQ ID NO: 173999 - DNA, 540 bp, Homo sapiens
  Payload ID: 14159
  Gene Symbol: RAPGEFL1
  Gene Name: Rap guanine nucleotide exchange factor (GEF)-like 1
  ENST ID: ENST00000538884
  CDS Start-End: 479-540
atatttctgtgagtatgagaaaggtgcacactcttgggttcagcaatctgtaggcctgacttgggtacacaggcgagcccttgacttcgccgccctgggcccctctgggcgcccccgagcggcccgagcatcttctgaaccgggttctggagcggcttgctggaggggctaccagggacagcgccgcctcaggcagaactcaaccttggtgtgttatctgaccaacttcccacatacgctgaagagaagtgcacatggccatcaaaggcacgcgccccccccttcccttcagctgccttggcagctgccgaacccaccctcgcagtggctgcccagaacctttacacatgtatgtgtgcgcgtgtgcagagcatgacaagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttctt

SEQ ID NO: 174000 - DNA, 560 bp, Homo sapiens
  Payload ID: 14159
  Gene Symbol: RAPGEFL1
  Gene Name: Rap guanine nucleotide exchange factor (GEF)-like 1
  ENST ID: ENST00000543876
  CDS Start-End: 114-560
aatgctaattcacccaagaggccttcccagctcttctcacagaaggaagataaactccacatatttctaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagccc

SEQ ID NO: 174001 - DNA, 779 bp, Homo sapiens
  Payload ID: 14159
  Gene Symbol: RAPGEFL1
  Gene Name: Rap guanine nucleotide exchange factor (GEF)-like 1
  ENST ID: ENST00000538981
  CDS Start-End: 476-779
ctctgtgtttggaaatactctttgtctggagacacttctgtgggctacttcttttttcaggcagaactcaaccttggtgtgttatctgaccaacttcccacatacgctgaagagaagtgcacatggccatcaaaggcacgcgccccccccttcccttcagctgccttggcagctgccgaacccaccctcgcagtggctgcccagaacctttacacatgtatgtgtgcgcgtgtgcagagcatgacaaggcaggtggctggggctccagcctggctaaagagaacttgcccttaggggcaagagagggaggcactgcatttccagtttcgttctggaagtgcccacctgacatctgtggtgcccactgatctttacagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccggg

SEQ ID NO: 174002 - DNA, 382 bp, Homo sapiens
  Payload ID: 14159
  Gene Symbol: RAPGEFL1
  Gene Name: Rap guanine nucleotide exchange factor (GEF)-like 1
  ENST ID: ENST00000541245
  CDS Start-End: 196-382
gagctgtccccaggcgagcccttgacttcgccgccctgggcccctctgggcgcccccgagcggcccgagcatcttctgaaccgggttctggagcggcttgctggaggggctaccagggacagcgccgcctcaggcagaactcaaccttggtgtgttatctgaccaacttcccacatacgctgaagagaagtgcacatggccatcaaagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccagg

SEQ ID NO: 174003 - DNA, 3855 bp, Homo sapiens
  Payload ID: 14159
  Gene Symbol: RAPGEFL1
  Gene Name: Rap guanine nucleotide exchange factor (GEF)-like 1
  ENST ID: ENST00000620260
  CDS Start-End: 1-1989
atgaagccgctggagaaatttctgaagaagcagacgtcgcagctggcgggccgaacggtggcgggaggtcccggcgggggtctggggagctgcggtgggcctggagggggtgggggacccggcgggggcggcggtccagccgggggacagcggtcgttgcagcggcgtcagagcgtgtctcgcctgctgctccccgctttcctccgggagccccccgccgagccggggctggagccgccccctgaggaggaaggaggagagccggcgggggtcgcggaggagccgggcagcggggggccctgctggctgcagctggaggaggtgccggggcccgggcctctcgggggaggggggcccctgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccacctctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaacctg

SEQ ID NO: 174004 - DNA, 1744 bp, Homo sapiens
  Payload ID: 14159
  Gene Symbol: RAPGEFL1
  Gene Name: Rap guanine nucleotide exchange factor (GEF)-like 1
  ENST ID: ENST00000613811
  CDS Start-End: 368-1744
cgcagccgccgccgccgccgccgccgcgtcctctcagccttgcgctccgcccgctgcctctgccgccgcagcgcagagccgggcgcaccggccccgcagcctgcccactcttcgggccgcgtgccggctgcagccggcatggggggttgctgagagcgagcactcctttcctctggcacctcccccggctactggccactggactctggccagcgaggctcggcccctctggcccccagtctggcgcctggcacggccctctactctgctcctccagctctgagcatcgtgtcttcgccgccccccccgcccgcgcctgggatacctgggtcccccggcgacccctaggagaggggcgggggggggcatgaagccgctggagaaatttctgaagaagcagacgtcgcagctggcgggccgaacggtggcgggaggtcccggcgggggtctggggagctgcggtgggcctggagggggtgggggacccggcgggggcggcggtccagccgggggacagcggtcgttgcagcggcgtcagagcgtgtctcgcctgctgctccccgctttcctccgggagccccccgccgagccggggctggagccgccccctgaggaggaaggaggagagccggcgggggtcgcggaggagccgggcagcggggggccctgctggctgcagctggaggaggtgccggggcccgggcctctcgggggaggggggcccctgcgctccccttcctcctactcatctgacgagctgtccccaggcgagcccttgacttcgccgccctgggcccctctgggcgcccccgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgc

SEQ ID NO: 174005 - DNA, 3584 bp, Homo sapiens
  Payload ID: 14160
  Gene Symbol: RAP1GAP
  Gene Name: RAP1 GTPase activating protein
  ENST ID: ENST00000290101
  CDS Start-End: 259-2337
ctccccgaactgcggcggcggcgagcgccggccgcatctgagcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaagctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtacccaga

SEQ ID NO: 174006 - DNA, 600 bp, Homo sapiens
  Payload ID: 14160
  Gene Symbol: RAP1GAP
  Gene Name: RAP1 GTPase activating protein
  ENST ID: ENST00000317967
  CDS Start-End: 311-600
gcggccgcgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaa

SEQ ID NO: 174007 - DNA, 3318 bp, Homo sapiens
  Payload ID: 14160
  Gene Symbol: RAP1GAP
  Gene Name: RAP1 GTPase activating protein
  ENST ID: ENST00000374761
  CDS Start-End: 156-2240
cgtggggcgagcccatcgcaggcagcgccgccgccgggagccgggagcgcggagctcagcgctgcggggcccggacccgggcgcgcgcgggccaggagccggctgggccagctgaagtgccgccccggcgggggccgggccgggccgcgctcaggatggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 174008 - DNA, 3334 bp, Homo sapiens
  Payload ID: 14160
  Gene Symbol: RAP1GAP
  Gene Name: RAP1 GTPase activating protein
  ENST ID: ENST00000374763
  CDS Start-End: 10-2256
ctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 174009 - DNA, 3271 bp, Homo sapiens
  Payload ID: 14160
  Gene Symbol: RAP1GAP
  Gene Name: RAP1 GTPase activating protein
  Uniprot ID: P47736
  ENST ID: ENST00000374765
  CDS Start-End: 202-2193
ggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 174010 - DNA, 429 bp, Homo sapiens
  Payload ID: 14160
  Gene Symbol: RAP1GAP
  Gene Name: RAP1 GTPase activating protein
  ENST ID: ENST00000447293
  CDS Start-End: 323-429
aaggggctcttgagggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggt

SEQ ID NO: 174011 - DNA, 3238 bp, Homo sapiens
  Payload ID: 14160
  Gene Symbol: RAP1GAP
  Gene Name: RAP1 GTPase activating protein
  ENST ID: ENST00000471600
  CDS Start-End: 191-1999
gagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcacgtggctggaggacagtgtcagcaccactagtgggggcagctccccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgta

SEQ ID NO: 174012 - DNA, 2489 bp, Homo sapiens
  Payload ID: 14160
  Gene Symbol: RAP1GAP
  Gene Name: RAP1 GTPase activating protein
  Uniprot ID: P47736
  ENST ID: ENST00000495204
  CDS Start-End: 15-2198
gcggcggcggcaccatgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctg

SEQ ID NO: 174013 - DNA, 3426 bp, Homo sapiens
  Payload ID: 14160
  Gene Symbol: RAP1GAP
  Gene Name: RAP1 GTPase activating protein
  Uniprot ID: P47736
  ENST ID: ENST00000542643
  CDS Start-End: 304-2349
cgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgt

SEQ ID NO: 174014 - DNA, 6661 bp, Homo sapiens
  Payload ID: 14161
  Gene Symbol: RAP1GAP2
  Gene Name: RAP1 GTPase activating protein 2
  Uniprot ID: Q684P5
  ENST ID: ENST00000254695
  CDS Start-End: 91-2283
actgaccccgctgtaccacggccctcttgcggacagccccggggacgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggggatcaagcttgaagagcagaagccgggaccccagaagaacaaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggaggggggcatttggctggaagactggaatttaattgccatcgtctttgattttgtgacatttctgcttggaagtgtgaactacccccccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtc

SEQ ID NO: 174015 - DNA, 6616 bp, Homo sapiens
  Payload ID: 14161
  Gene Symbol: RAP1GAP2
  Gene Name: RAP1 GTPase activating protein 2
  Uniprot ID: Q684P5
  ENST ID: ENST00000366401
  CDS Start-End: 91-2238
actgaccccgctgtaccacggccctcttgcggacagccccggggacgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttaactgacattgtgaaattctccctatagcttttgccattcaagcaacattgtgatctttcttccccgccacgtgtgtgggaatgattgagtcctgtttgcaagctggagaggagctctccctttgctagtactttctctaaagtactagtctagtaaaatttattcttgttagaaggtcaacaaaatatctgtttagcttttatgaagagtcaccgtagcagcccccacggctggaaagaggcctgtacgttctggacgcgttttgttggctgggcttctggaggcactggcaaggtcaaactgcatttctttaagaacagttgcaggatctggctcgcctctgtgggaagccggcattacaggtgcttggtggatgggccgtgtcacattgccatctggggtcctttggggtttccaggttgtcaccatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgagatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccaatcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggagtaacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggctgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaaacgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggaggggggcatttggctggaagactggaatttaattgccatcgtctttgattttgtgacatttctgcttggaagtgtgaactacccccccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattctaaaaggttgacaaatgtatattttgttgcttaaatgtgtctttgcagaaattgacaataaataacatattttgtgtc

SEQ ID NO: 174016 - DNA, 3218 bp, Homo sapiens
  Payload ID: 14161
  Gene Symbol: RAP1GAP2
  Gene Name: RAP1 GTPase activating protein 2
  Uniprot ID: Q684P5
  ENST ID: ENST00000540393
  CDS Start-End: 237-2372
gcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctatagggtgtgtgtgcgtgcgtgaggtgtgcagcccctgtcaggatctggcgagagaagctgaccgggatggaggtcagaggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggggatcaagcttgaagagcagaagccgggaccccagaagaacaaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatatt

SEQ ID NO: 174017 - DNA, 3110 bp, Homo sapiens
  Payload ID: 14161
  Gene Symbol: RAP1GAP2
  Gene Name: RAP1 GTPase activating protein 2
  Uniprot ID: Q684P5
  ENST ID: ENST00000542807
  CDS Start-End: 47-2239
acgtcgttgggacatcgctgggaccccgggctctgcagccacaaccatgtttggccggaagcgcagtgtctcctttgggggcttcggatggatcgacaagaccatgctggcaagtctgaaggtcaagaagcaggagctggccaacagctcggatgcgaccctcccagaccggccgctctcccctcctctcacggcacctcccaccatgaagtcgtcggagttctttgagatgctggagaaaatgcaggggatcaagcttgaagagcagaagccgggaccccagaagaacaaggacgactatatcccataccccagcatcgacgaggttgtggagaagggaggcccgtaccctcaggtcatcctgccacagtttgggggctattggatcgaggacccggagaacgtgggcaccccaacatcgctggggagcagcatctgtgaggaggaggaagaggacaacctcagccccaacacatttggctacaagctcgagtgcaagggtgaagccagggcctaccggaggcacttcctggggaaggatcatctaaacttttactgtaccggcagcagcctggggaacttgatcctgtccgtcaagtgcgaggaagcagaggggatcgagtacctccgggtcatccttaggtccaaactgaagacggtacatgagcggatccccttggctggactgagcaagcttcccagtgtccctcagattgcaaaggctttctgtgatgatgcagtgggactgagattcaatcctgtcctgtaccccaaggcctcccaaatgattgtgtcctatgatgagcatgaagtcaacaacacattcaaattcggagtcatttatcaaaaagccaggcagaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccggaaatctgccccaacaaggagaagcccttcatgaagttgaaggaaaacggccgtgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgtaccagcagtttgggagtgccgtccacgaccctgacagtcccagccctgctgccccatggccacgtgcccacagatgtgctgttggtccaggtgtcccagtctggccacagccctgcctccgccctcacctacatgccctcccagcccctcccatctctggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccccttccgagtctgcagcgcc

SEQ ID NO: 174018 - DNA, 1686 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000264572
  CDS Start-End: 136-1686
ctccccggcggccgccccccgcgggtccctccctggctgcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctga

SEQ ID NO: 174019 - DNA, 2092 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000339360
  CDS Start-End: 49-1875
cacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccg

SEQ ID NO: 174020 - DNA, 2085 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000380158
  CDS Start-End: 150-1829
agcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtaga

SEQ ID NO: 174021 - DNA, 3681 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000408927
  CDS Start-End: 114-1937
gggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaacttctggtttctcctttttcctttttagactattgaaactgccacaaacttggcaagactttctgaggtttctgattccatatttaattgactattatcaatagcctgatattgaaaaacatttgtagttttcagtgtgaaactaaggggttgaagaatcactattacaatccctattacagagcatttcgggttttgcttgtattttagattctgatacatacgctgtttcactcaggaactacttctaccagttaatcagcattatccagcacttgtctttaaaattcatttggcgcttgtttgttttcaactgaggaaattgagtatagttcattgaagaatggaatttttttttttttttttttttttgctgtttttcatcattcagctagaaagtgagaagttttatcttccatagtccttttaaatcttatgttagaactagcaggacgtaggtggaaagatgaagaaataagcttgtctagactaaagaaaggaaagcaggttataaaagccatagtagccagtccagttcattctgcagatggccccataccaatcgctgttagagtttgccacctccactttcccactgagaactgcagcaattttaaaggatatgagaaagccaagactcaagagatgagaagacccccttggcgaaatatagtgtactcttcactgccactgccaccaccaaatgggtttttagagctttgaaacacaatctttgtaaattaatcaaaacctccctgtgacccacctgccttctccccatacccaaatttgaccactactggcctaaaaggcaagatgggcttcgatatagaaggactgcaagacagtagaaagggctgccacggaggtgacagtagctccttcctctccaacatgtgatgctacacatctctgtggataatctaagttggacttttgactctaaaacagctataatccaagaaagttaaattctaatggaggtaaagaatcttgactgattgttccctttgatgtccaaataagggaactattgtgagtacgtatgctacacttactataagaatgatactgtttgttgtctttctcctgggctggatagtggactatattttattacaggctttgaaagacatctgtaatgttgcatatctgttcatattaataacttaataaatagtatatgaagctataa

SEQ ID NO: 174022 - DNA, 1942 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000408900
  CDS Start-End: 49-1725
cacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccg

SEQ ID NO: 174023 - DNA, 2470 bp, Homo sapiens
  Payload ID: 14162
  Gene Symbol: RAP1GDS1
  Gene Name: RAP1, GTP-GDP dissociation stimulator 1
  Uniprot ID: P52306
  ENST ID: ENST00000453712
  CDS Start-End: 98-1921
gcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 174024 - DNA, 757 bp, Homo sapiens
  Payload ID: 14162
  Gene Symbol: RAP1GDS1
  Gene Name: RAP1, GTP-GDP dissociation stimulator 1
  ENST ID: ENST00000509501
  CDS Start-End: 1-757
cgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaat

SEQ ID NO: 174025 - DNA, 555 bp, Homo sapiens
  Payload ID: 14162
  Gene Symbol: RAP1GDS1
  Gene Name: RAP1, GTP-GDP dissociation stimulator 1
  ENST ID: ENST00000511212
  CDS Start-End: 81-555
agagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacag

SEQ ID NO: 174026 - DNA, 573 bp, Homo sapiens
  Payload ID: 14162
  Gene Symbol: RAP1GDS1
  Gene Name: RAP1, GTP-GDP dissociation stimulator 1
  ENST ID: ENST00000503667
  CDS Start-End: 171-290
cgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaatagatgaagaccattttgtgttgccggggggaccataaagtgtgccatacagctttaaactctctccctgaagaaatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacg

SEQ ID NO: 174027 - DNA, 544 bp, Homo sapiens
  Payload ID: 14162
  Gene Symbol: RAP1GDS1
  Gene Name: RAP1, GTP-GDP dissociation stimulator 1
  ENST ID: ENST00000508490
  CDS Start-End: 144-260
agctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaatagatgaagaccattttgtgttgccggggggaccataaagtgtgccatacagctttaaactctctccctgaagaaatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgg

SEQ ID NO: 174028 - DNA, 537 bp, Homo sapiens
  Payload ID: 14162
  Gene Symbol: RAP1GDS1
  Gene Name: RAP1, GTP-GDP dissociation stimulator 1
  ENST ID: ENST00000510870
  CDS Start-End: 81-437
agagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatggtgaggtttacctcaagaacttttctgctgggaacgtcttcagttttacatcttacttagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttatt

SEQ ID NO: 174029 - DNA, 579 bp, Homo sapiens
  Payload ID: 14162
  Gene Symbol: RAP1GDS1
  Gene Name: RAP1, GTP-GDP dissociation stimulator 1
  ENST ID: ENST00000514122
  CDS Start-End: 106-579
ccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgct

SEQ ID NO: 174030 - DNA, 549 bp, Homo sapiens
  Payload ID: 14162
  Gene Symbol: RAP1GDS1
  Gene Name: RAP1, GTP-GDP dissociation stimulator 1
  ENST ID: ENST00000509011
  CDS Start-End: 183-549
gctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttg

SEQ ID NO: 174031 - DNA, 558 bp, Homo sapiens
  Payload ID: 14162
  Gene Symbol: RAP1GDS1
  Gene Name: RAP1, GTP-GDP dissociation stimulator 1
  ENST ID: ENST00000508213
  CDS Start-End: 116-558
gcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattact

SEQ ID NO: 174032 - DNA, 1103 bp, Homo sapiens
  Payload ID: 14162
  Gene Symbol: RAP1GDS1
  Gene Name: RAP1, GTP-GDP dissociation stimulator 1
  ENST ID: ENST00000514139
  CDS Start-End: 1-304
gaatgattcgcttcaagctcagcttatcaatatgggtgttattcctaccttagtgaaattactgggcatccactgccaaaatgcagctcttacagaaatgtgtcttgttgcatttggtaatttagcagaacttgggtgtacaggaagtgtggtgcctgcatctgcttctggtgagggactcaggaagcttacaatcatggcagaaggtgaagagggagcaggcgtgtcacatggtgagacagggagcgagagagagagacaaaggggaagtcacagactcttaaccagatctcatatgaactaactcacttatcaccaaggggatggtactaaccattcatgagggacctgcccccattatctaattacctcctgcctggcctcacctccaatattggaaattacgtttcaacatgagatttggaagggacaaacagccaaaccacatcagggagttttcattggacaaataaggaaaaataatatgaggacaaaagcagagcacagtatactgagggagccctggcctggtaggagagaaaagaggtaagtaaagagttgcaaagacaaccttgtctaccttgctgatttctctggtatacagggaaaataagccattgaaaacagtttgatacaagttgctgtgctaagatagcagatttgtttgagaggctgcgtagaccacctctattcagcctagtctcccccagtctatgttaaaagataaatatgcagctaatttagttcagcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttactttttgtcaaaatgtttttaataaaagtgttaaataacaaa

SEQ ID NO: 174033 - DNA, 1586 bp, Homo sapiens
  Payload ID: 14163
  Gene Symbol: RAP1A
  Gene Name: RAP1A, member of RAS oncogene family
  Uniprot ID: P62834
  ENST ID: ENST00000356415
  CDS Start-End: 320-874
atccttcgcgtactgacggaaacactggcggcacatattgaggccgtatttcaggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtaggagttggaggagagaaatgaaattttggaagagtcagcagaagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttc

SEQ ID NO: 174034 - DNA, 5024 bp, Homo sapiens
  Payload ID: 14163
  Gene Symbol: RAP1A
  Gene Name: RAP1A, member of RAS oncogene family
  Uniprot ID: P62834
  ENST ID: ENST00000369709
  CDS Start-End: 180-734
ggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccggggggatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgagatattttatgacctggtcagacagataaataggaaaacaccagtggaaaagaagaagcctaaaaagaaatcatgtctgctgctctaggcccatagtcagcagcagctctgagccagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaagataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatgaaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaatcaagagtttctaggatattgtgtgaatgtcaaatgataaatatctagaaactgatttcatattagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgccctgtcgcccaggctagagtgcaatggctcagtctccgctcactgcaacctctgcctcccgggttcaaacagttgtgcctcagtcttccaagtagctgggattacaggcacccgccaccacgcccagctaatttttgtatttttagtagagacggggtttcatcatgttggcgaggctggtcttgaactcctgacttcgtgatccgcccccccctcagcctcccaaagtgctgggattacaggcgtgagccaccgcgcctggcccggttaatactttcataagcattgaagtaactatttaagtcctagtacataaacactgtgtggttcacaaaaaggcatagagacattctctcaagagtttacaatctaattgggcagggaagatactacagttcatcaaagatatgaataacaccctagttttctgaactgcagctgcatgggtaattatcttaagaacttttggcaaaatatggatgttggtgtgttactctcttctccctacaactctgaactaatctgtgtttggcaccttgatttgccatcataaatggccaccatttactcctcactgaaatattcttcttctttgaggttataatgtacttggaaaagttaatacttatagaaaataatgatctttattaccaactttattaaaacaggcttggaacatttttctccatagaagaatagtaataagacattctacatttcctggacatggccagtttaaaatattttgccccattacccttgtagatacacatgtatttgtcagtttatgtgcctcagttttgtcttaggcactgagggacagaaagagaaataaggaataccttggtattttcctttgcaagcaatcacagcagaatgctagaaaacataaaatatactcttataaattgtatgtgtgttgaaaccaaagtgtgaagaaattgtcaggtatttggaggaggaaaataatttgtaaaataacctttttaagaatttggattttgtacttatttaaggtgctaaatatgtgttaaaatatcccctcttgaatcagctccaggcttaaaagggcagagtggtttggattcttgtccagggtctggaaagagctcatcttgccgagagggaaataaatgtgagctttgaggcggtctaactacccagcttttagtatttatgttccccaaaatgtaaaaactgtaagttattcttgaaaatgtagtccagacatttctttgatcctggattttactgcagtttcatcatgggtttgttgaatgtgcagtccatttattgccctgtcttgcttaaatattcttgttgagaacagctggaggctttgactgggttcctagttctgttttctgggaaggcaacgtggattctgttttgtagacattaatgagctttaaatgggaattggggatgatgtatgttcgttgggcatgctgagaagcggcctcctgtggttctgggcccaaggtgtgacatacatttcccactaattgcttctctcaagaagcaagagattggctgttcctcttgaggaaaaaccttaataaaccttcccattttaaa

SEQ ID NO: 174035 - DNA, 666 bp, Homo sapiens
  Payload ID: 14163
  Gene Symbol: RAP1A
  Gene Name: RAP1A, member of RAS oncogene family
  ENST ID: ENST00000433097
  CDS Start-End: 280-666
ggaggaggcgccgccgccgctcccgaggcccctgccgccgccgctcccgctgctgtcgccgcgcagagccggagcaggagccacggccgagaggagggaggaggaggaggaggaggtggaggaggtggaggaggtggaggaggcgccggaccgggggggatagattcccagaagtgggataactggatcagagggtgattaccctgtgtataagagtatgtgtctcactgcaccttcaatggcattgagtagatcgtcagtatttaaacagatcacatcatgcgtgagtacaagctagtggtccttggttcaggaggcgttgggaagtctgctctgacagttcagtttgttcagggaatttttgttgaaaaatatgacccaacgatagaagattcctacagaaagcaagttgaagtcgattgccaacagtgtatgctcgaaatcctggatactgcagggacagagcaatttacagcaatgagggatttgtatatgaagaacggccaaggttttgcactagtatattctattacagctcagtccacgtttaacgacttacaggacctgagggaacagattttacgggttaaggacacggaagatgttccaatgattttggttggcaataaatgtgacctggaagatgagcgagtagttggcaaagag

SEQ ID NO: 174036 - DNA, 13438 bp, Homo sapiens
  Payload ID: 14164
  Gene Symbol: RAP1B
  Gene Name: RAP1B, member of RAS oncogene family
  Uniprot ID: P61224
  ENST ID: ENST00000250559
  CDS Start-End: 232-786
acccgcgcgccccgcccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggttttaattgtaataggtgcattttacacagcatggtttcataatttaacatctgggcaagccagactcattaattacaggaataaggaagtagcgagttttctggtattgtttgaatatccacataaccaccttttgaacttttccttgagaaataattttgtaaatcaagcagtattacttacgaataaatgcctttgggtaatgttcagtagctatttgatgaggtaggtaaaagaggaacgatttaacatactttcatggatgttacactatggattttttaaaatacaggattgaagttagaatattgtggttataaaaatctttgagtgatgtggattaagcacttagagaatcgatatttttcttaaatatgctataattgaattctgtaagaactgaattcttatagaattattttaaaactttttaaaaattgtaaagctcttaaaaaactttttgaaagtatttgccagctactggagcaattaatcagtgataatatctaatagaggggtatctgctaatcccctaaatacacgctgtttgaatgatacatttttaaaggctttcatgttaagaaaaagtctgattctttacaaaagggacttgttttggcagaactggttttatttataatcatttgggaaaaaaattaagcccaaaaaactgggactgtgaaacactaaaattacttcaatttactatgtcctgttacatccattgataccgccattattcaataattacttttaataaatgtttgctgcctaccagctatgtaccaggcccagttctaggctcaaacagctaaatattcattcattggacaaattaagtacttaagtataaaaattgttctaggcctaaggatgtagcagcaaccaagatcaactataaaatgctgccctcctagaatttatattctattgaagagtttctcagcctcagcactattgatgttttatgtttgataatgtattctggcgactctcctgtgcattataggaattttaatatctgcccactagatgccagtcacaccaccccagcccccaagttgtggcaaccaaaaatgtttccagacattgccagatgttccccagttggattgttgggggacaagggaggtgaacttggagggcaaaatcaccctggtgaagaactactgctctggtgggaaacaacacattagttacagatgagtgttagggttacaagatggatggtttactatatagtgaataagaatataaagtttggagccagacttcctgggtttttaatcccagctcttccagttcctactatatgcctttggttgggtgccttggtttcctcatctgtaaaatgagaatgataatacctacttcataggagagtgaaatgaatgccagtgctatcctctaggtctatatatatatatatatatatatattatatatagtacatatatagagagagtatatatatatatgtagtacagtggaggtctatataatactatatatataatttatttttttcaatgctgataggaataaggctgtggtttggcaaaaagcaccattttctcctatacaaaatagtaactgcagtttgggagcacaactcatgtagattgacttttctggtgcttaatgggaaaatactaaaataattgagtcagaaaaggcatgaattccttttcacgtccccaaggatacttgaagaaacttgagttttaggagaaaatcagagtggtctttcacttacatttttctaaaaagtgtaaaaaccctgtattgactttcttgttgattcagttgtttcttaaacgtaaatagctcatctttaccatatgtgggcattacaaatagaaatttttaaaattccatttataaaatgaagttttgccgtttttttttttaaatcattccgtctttagttgtgggacagcaaacttagaatcgaaactcatcactacaacttttctttgagttaaactcttatctgtgttttcattgaatttaatctccatctattctatctcttcttaaatcttggaaatgtaaaagggagttatagtgttttacaattaatactcttactattaccttagaagccttaaaagtgcttgcaggcttgtctcataatctgtcagtgagccttaacattgtgatttgtaagactaaaatttttttttcaaacaaaacaaatctgacagcctgggcaacatagaccccatctctacaaaaaaaaatttttttttaattagctgggcatggtggtgcacgtctgtacctgtagtcccagctattcagaaggattgcttgatcccaggagatcaaggatacagtgaactgtgttcgcgccactgcacccccacgatggcaatagagtgagaccctgtcttagaaaaaaaagataaataagtctgttctatttgttacagtgcatcaacacatttgaattttctttttttttctttttcttttttttttttgagactgagtttcgctcttgttgcccaggctggcgtacagtggtgcgatcttggctcaccccaacctctgcctcccaggttcaagcaattcttctgcctcagcctcctgaatagctgggattacaagcatgcaccaccacgcctggctaattttgtattttttggtagagatgaggtttctccatgttggttaggctggtttcgaactcccgacccaggtgatccgcctgcgtcagcctcccaaagtgctgggattacaggtgtgagccaccgcacccagcctaatcaatacatttgatatttcaagaatacatgagagaagagaggtagattgagaacagaactaaactttatatatgtttccttaactattgggaggaaaatggatgagtctgtgttgggatacctgttgaaacaagactactaaacagattaatcaactaattccataggcttgacattagtttatctttgaaaagtaaaagtaaagtgcttattgctaaataggtctgtattctaaatgctgccattttttaaaaaaagtattccatgttacacacattttaaacttgcttcttaaaacatccctgttggtggcctgtaggttactgaccttaggaattacaggctttatccaaaattaggcatatctacctgatttttgtatctgagaatcaataaatgcattcagtattctctaccgtgtttcaggcgctgtttacaatatcggaggtacagcagggattttctgcccacgtggggaaaacacacagcaaatgaacaaagctctattggtaacagtctgttaaactttctaagagctttccaactttctaagagaaaattgtaatgattttagaaaagtgagctgtcatttttcatatatataaatttttttattcataggtaatctaatttttctcatttctccaaaagggtacgaagacagtttttactatgttgttttactatgaacctagtttaacctgactttccttacagacccacataaatgagacaatccaaatttagtatttgggtcaaaatgcagggttttttcctgaaaacaaaacagcacacacatatattacaggatttttatgtaataatatattcacttcagtcaggtttcagtttttaaataggcagagatcaaaagcctctaatgtttttgtcatccgccattattacccattcaaatttctatttatgtctggtagttatgtcccctgtgagcactaatttcagaacaggaaattctattaactgtcaaactctttaatgtgcagtgcagtaggtttggagcagaggggagtaggaaggagtaaatgatataatccagtctggcctggcatggtggctcacacttgtaatcccaatgctttgggaggccgagatgggtggatcactggaagccaggagtttgagacaagcctggccaacatggtgaaaccccgtctctactaaaaataacaaaaattagacgggcacggtggtgtgtgcctgtaatcccagctactcaggaggctgaggcaggagaatcacttgaacctgggaggccgaggttgcagtgagctgagatcacaccactgcacttcagcatgggcaacagagtgagactgcaaaaaaaagaaaaagaaaaaaaaatccagtctctgctggcaaggtgtttaacaagtcaatgatgggaaagaccagtcaaataaactatcagatctaataacttttctaaccataggtgattcttcttccattatccatactaaagcaagtgactcataataaaaattgttattttgtaaaatatatggactgtttgctttatattcccaactattacatctggttgactattaacaggtcaatgtcagatttcctgagcaaatcaaccaataatgaaaaactatgtggctggcagaaaaaaataagtgcgtgtggtggtgcttgcctgtaatcccagctgcttgggaggctgaggtaggaggaactcttgagctccggtggtttgaggccagcatggataacatagggagaccctgtcacttgacaaaagtatctttccctactggaaatggaatagaatcggatgggtatggtacagcaggtagttatggggagacctctactgttctaaatgagactaatagtaaatgttacataactaaagcaacagatttgccagctgtgtgaaagataacccagagaggggtaatggtagagccagaattaacacagccagcttgtcagctacctttgaacatgtattttctgtgcagtcagatttgaagggttggaccttggagttactgacattggaggcaactgaaaccatgagtgtgaatgaaattattttcgtaagaattacttggggttaaaaatagtaataaaaaggaaagcctggcctaaacagtcttgggatggggagaagggttggagtacaaaggattgctattacaaagacatgggcagagaacaaggcaaatagctgagcagcaattgagaatacagcatcttttatggcaaagagcaaaatactattgttcctcttctagtatgctatagaccagcagtaattttgtgctctaaaatgcttatttttatctctctgtatatacttggtggtgaatttgctacaaatgtaaggagatgatgggatagtttttggaaataccatcctctaattagtaccaggtctatgtatatctgcagcaactataaagtctgtttcagagtcagtattggcaaacttatatttaaattcagctgtaacaagacatctttttttttttttttgagagagtctggctctgtcacccaggctggtgtgcagtggcgcgatctcggctcactgcaacctccgcctcccaggttcaagcagttctctgcctcagcctcccgagcagctgggattacaggcatctgccaccaagccctgctaatttttctatttttagtagagacggggtttcgccatcttggccaggctggtcttgaactcctgacctcgtgatccatctgcttcagcctcccaaagtgctgggattactggcatgagccactgcgcccggcaagttgtctttcaaatatatgcctttgcagtatttctctacttccccagtaatgtaaactttattttctctcaattttcgtaagtggtattttggtgctttacccaaaatattagggagaaaattcttctttttaattggattctcgtatgttgatctatttctattgttttctaaaaaaaagttagtgtcctagtttaaaagtatatattagtttcctagggctgctgtaacaaattatcacaaatttggtggcttaaagcaacagaaatgtactctttcacagttctgaaggtcgaagtccaaaatcaaagtgttaggatgtactcctagaggctctcggagagaacctgttcccatggcattatgccacatcacatgtgcctctatctttgtatctcctcctctctataatctttcttttaaaaggacaattgttttgacatttagggcttacccacatacttcaggataatctcatctcaaaatgcttaatcacatctgcaaagacacttttttcaaataaagttaacagacagaagtttgggggttgggatgtggacatgcctttgggagccattaacaacctaccaaaacattttaacaatttttcagtaccaaagactagtatgggtctgctccaagataactcaaaacattctgaactgaatcagcagaccctcaggtctccctagagagatcctgagcacctaggaaagccccagaattaagctactctacaaggattctgagggaagtctgggattaggtgagactttaatgagtccatcagaggtttagtatggactagttctacagttccagaagcaacatactgggtatggaatattgttaaccattgtcatcccacagaattaccttctacttgtgtcagtatatatcctgcctaccctacatattttatatttatcaatgatgacagaaacttccccccttttacttagatctaatagtaatataacaaacttttctttttcattttcagacatatccagagggttttctcttcatctcacgcatcccacctttaatcagacatatgtgattcatatgagagaaaattagtgtttctgagaccaaatggtggtgtttataagattttgcttctgcactgaattcaatgttttatttactgcttggttattttgtttttgttttttaagaaatgggaggagtgtaatatctagaggtacatgaaaaaaagaaatggaaggaatggacaggcccagaattaaatgataaaaactcatctggttggaatgaagtacactgaacatttgaggaagttagagattaattcaacccagtgggttttggggtttttatatgtgttagtacattcagcgttagggttgggtttcttgtctctgtaatcacttctcaaaaatgaatttgggcttctccagatagcctttttatccatttattatttcaagtaatggtataaggaaattgtaaccatttgtgtgctttacatgtttaagatacaaacttacagttcccagaagtcaattcagtcattctctataagagctgttgtggaaaaagttctcacttcacttactcattcctttgcattttccaactttagtaaagcatgacttcatgccttggatcatacaggatttcaacgggagatttataagtctattttgttagaataaaaagcaataatacttcctgaaatacatcttgggctctttgcagaagctgaactatctggtaattactatttagcaaacagctaacagctagctcttaatttttcagaaataagaggacatcattggccactatcataccactaattttattccaccaatgctttcacagaggatgtcaccaaagaaagaagtggcatccactacccctcccccatccttccactctgaaccagtacaggatattctcatggtcagggcattctctccttggcaggatgtagttaatgacatatgcagaattaatgacttggttgccctaggccccccgtcaaggcttttgttcaagggagagtaaagaggataggtctcagtatgtcatccaaacaggatggatacagaatgccaaccaggttagccctggcaagttaagacattttacagtgccactacctacctccatactgtatcagaggagccagttgcacagtgttgatctccctaagactattataataaggaaggggtttttttcttagcccagttactactaaaactcactcagaggagcaagtgaaatttgtcacaattggctcgactgctttatctcactttgaaaaagaaaagttacaaattctagtaagcaaaagattttttgtgaccaggtctccctgacctgcacaaaataaactcttcatgagttaaaccaaaacagatttaatgtctaaacttaaatctagtttgacattaacttcttttccaaagagaaataacgttaacaatctgaaatcatccctgcacagactttcttggctcttcttttctgccgtcctatgaatcacaaatagaagtttaagaaagctgtcaggtaggcgcctcaaattcatttaaaatgaggaatgatgaaagaataagaaaaaccagcaaatgatagcttacttattcagttatttggcttgatactgcttgaaagtgacatttctagattaaagatctgataagctctgatagttgggaaataatactagttatttcttggacaccctaagatgtgccaccattgctctaagcactttacatgtgttgttcaaccctcagcaatgctatgaaataggggctgagtctcctaatagagctaatgaatgcattatatcaaaagaatgaaatgttaaatatagacactggaaaataaaattacttttgcttgtattataagtgaataccttgaaagctcaaaaaaatctattagaagtattcaggaacttggctggatataagataagcatgccaaaaatcaatagcttttctttatatttataaaaaatacctacaagttgatatagtaaacacgacagataaaaactaaatgccttaaggtataaggctaagaaagaactattataaactcttattgaaggacataaatcaagatctgaacaaatacactgggaagataatatcataaaaatatcaattcccccaaattagcatgttaatgtataatgattacaatttaaatttcaactggctgaggctttgtttttgtttttgattttttaatagactggatgttggtcttgaactcctgggctcaagcaagtgtcacaccttggcctcccaaagtggattataggcatgagccaccgtgccagacttgggtgaggttttgaaattgaaattaagcaaaatgggccgggcacggtggctcacacctgtaatcccagcactttcggaggccgaggggggcggatcacgaggtcaggagatggagaccatcctggctaacatggtgaaaccccgtctctactaaaaatacaaaaattagccaggcatggtggcaggtgcctgtaatcccagctactctggaggctgaggcaggagaatcgcttgaacccaggaggcagagggtgcagtagctgagattgtaccactgcactccagcctgggtgacagagcaaatctctatctcaagaaaaagaaaaaagaaaagaaattaagcaaaatgatcttaaagttcaagtgaaagagtagagtagaactgagtccagaactagattccagtatatgacgtttatacgtgacaaaaatatatttctttttctttcttttttttttttttttttttgagacagtttccctcttgttgcccagactggagtataatggcacgatcttggttcaccacaacctccgcctcccaggttcaagtgattctcctgcctcagcctcccgagtagctgggattacaggcatgtgccaccacgcctgggctaattttgtattttagtagagatggggtttctccatgttggtcaggctagttgcgaactcccaacctcaggtcatctgcccgcctcagcctcccaaagtactgggattacaggtgtgagccactgtgcccggccgacaaaaatatatttcaatagaaaatagtatcagtaaaatgctagcacaactaactatctgtctaaagacaataaaagttcaacccctatatcatgcaaaaagcactttccagatatattaaaatgttttcaagctataaagtaaaacagtagaagtcttagaagaaaatctaagagactagaaatctagagatagggtagaccttcttagctaatttttaaaaatgaagctatatttaagatatatatttcaagtaaataataagtgtgtgtgtgtgtacacacagatgcttctcagcttacaatggggttatgtcccaataagcccatcagaagtcaaaaatgtaagtcgaaaatgcatttaataccctgataaatccatcacaaagctgaaaaattataagtaaaactgtaagtcacagactgtatatataaatttaaaatttggcaaaatatattgcaaagtcaaatttgggaaagtatagcacagataaaagattaaactattcacggccaggcacggtggatcatgcctgtaatcccaacactttgggaggccgaggcgggtggatcacctgaggtcaggagtttgagactagcctggccaacgtggagaaaccccatctctactaaaaatacaaaattagctgggtgtggtggtgcatgcctgtaatcctagctactcaggaggctgaggcaggagaattgcttgaacctaggaggcgaaagttgcagtgagccaagatggtgccattgcactccagcctgggcaacaagagtgatactccgtttaaaaaaaaaaaaaaaaaaaaaggtaaactattcaaaagataaatggttgaaagatatataactaggcagtttagataagaacaaatccaaatggcccatcaacataaaaagatgctctaactgtagccagagaaatacgaatcaaagtaccaacgagcccaacacatggacgaaaacttcagagaacactacagtcccagaagagaggtaaagggcaagaaatgaatcatttattgctgatggaaatgtgcattgtagagctgatatctgttcaaattaaatatgcatatttgacctcaattctactactgatatctacaccaaggaaatgaaaggaaatgcacaagattatttattgccacactctagaaggaaaaacagagtgcatgcccatcaatagaatagttgaataaattatgattcatgcataatatagaacattatgcattcatttaaaaatgagtttgatgtttaaaggttgacttagaaggattcccgtgcaaagtgaacaaaacagaataccgagaaggatgtatgtgagggatgcatgtgggcacctgggaaaggagatgaagaaagcaactgaaggatatttaccaagttgttaatatgcattacctgacatggtgatataggagtaggggtgaggaagtgaaggatctgagtaggtggaaaaagaaaagcaaaagtacaacagcgggagaaaaaacaggatgactcgtctagaagagacattgtcagtaacaagtaaataacattttctggaatataaaaaaaaaagctatatgaatgtcatcattatatgtaaaatatgaatgtaaaatacatgggaggataatatgcattaataaaaattatggtgctggcaacagta

SEQ ID NO: 174037 - DNA, 1017 bp, Homo sapiens
  Payload ID: 14164
  Gene Symbol: RAP1B
  Gene Name: RAP1B, member of RAS oncogene family
  ENST ID: ENST00000378985
  CDS Start-End: 135-491
aggcgtgtaaaccagccggagcggcgcggcagcggcaggaccgccgtggcgcctagagtagcgacccggggggagcgcggggcgacgctggctgcagggacccggtgacagcgtgagaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtatgttcacttatctttcctctaacttttaatcactcaaccttattaagggcactctgtcatgaaagcaagtatagacttctttttgttggttctgaaaaataaatggtttatttttataagatatccatgagttagtatgctatcttattaattatttacttatcatcatgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatctcttgacctcgtgatctgcccacctcggcctcccaaagtgctgagattacaggcgtgagccaccactcccagccaaccccgt

SEQ ID NO: 174038 - DNA, 2049 bp, Homo sapiens
  Payload ID: 14164
  Gene Symbol: RAP1B
  Gene Name: RAP1B, member of RAS oncogene family
  Uniprot ID: P61224
  ENST ID: ENST00000393436
  CDS Start-End: 222-776
gggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 174039 - DNA, 468 bp, Homo sapiens
  Payload ID: 14164
  Gene Symbol: RAP1B
  Gene Name: RAP1B, member of RAS oncogene family
  ENST ID: ENST00000422358
  CDS Start-End: 371-468
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacga

SEQ ID NO: 174040 - DNA, 1466 bp, Homo sapiens
  Payload ID: 14164
  Gene Symbol: RAP1B
  Gene Name: RAP1B, member of RAS oncogene family
  Uniprot ID: P61224
  ENST ID: ENST00000450214
  CDS Start-End: 163-591
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgc

SEQ ID NO: 174041 - DNA, 855 bp, Homo sapiens
  Payload ID: 14164
  Gene Symbol: RAP1B
  Gene Name: RAP1B, member of RAS oncogene family
  ENST ID: ENST00000425247
  CDS Start-End: 384-855
gacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagaccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgaggtct

SEQ ID NO: 174042 - DNA, 640 bp, Homo sapiens
  Payload ID: 14164
  Gene Symbol: RAP1B
  Gene Name: RAP1B, member of RAS oncogene family
  ENST ID: ENST00000545270
  CDS Start-End: 274-640
tcgcccagattcaggcgtgtaaaccagccggagcggcgcggcagcggcaggaccgccgtggcgcctagagtagcgacccggggggagcgcggggcgacgctggctgcagggacccggtgacagcgtgagagggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatg

SEQ ID NO: 174043 - DNA, 633 bp, Homo sapiens
  Payload ID: 14164
  Gene Symbol: RAP1B
  Gene Name: RAP1B, member of RAS oncogene family
  ENST ID: ENST00000542018
  CDS Start-End: 340-633
agattcaggcgtgtaaaccagccggagcggcgcggcagcggcaggaccgccgtggcgcctagagtagcgacccggggggagcgcggggcgacgctggctgcagggacccgccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaa

SEQ ID NO: 174044 - DNA, 552 bp, Homo sapiens
  Payload ID: 14164
  Gene Symbol: RAP1B
  Gene Name: RAP1B, member of RAS oncogene family
  ENST ID: ENST00000545720
  CDS Start-End: 299-552
aggaccgccgtggcgcctagagtagcgacccggggggagcgcggggcgacgctggctgcagggacccggtgacagcgtgagaggttcgcagaccaggcatggtggtgtgttcctgtagtcccagctactcgggaggctgagcaggagaatcgctggaacctggcaggcagaacttgctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcac

SEQ ID NO: 174045 - DNA, 1072 bp, Homo sapiens
  Payload ID: 14164
  Gene Symbol: RAP1B
  Gene Name: RAP1B, member of RAS oncogene family
  Uniprot ID: P61224
  ENST ID: ENST00000537460
  CDS Start-End: 366-920
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatc

SEQ ID NO: 174046 - DNA, 1060 bp, Homo sapiens
  Payload ID: 14164
  Gene Symbol: RAP1B
  Gene Name: RAP1B, member of RAS oncogene family
  Uniprot ID: P61224
  ENST ID: ENST00000542145
  CDS Start-End: 142-555
gtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtac

SEQ ID NO: 174047 - DNA, 571 bp, Homo sapiens
  Payload ID: 14164
  Gene Symbol: RAP1B
  Gene Name: RAP1B, member of RAS oncogene family
  ENST ID: ENST00000540781
  CDS Start-End: 155-571
gtgtaaaccagccggagcggcgcggcagcggcaggaccgccgtggcgcctagagtagcgacccggggggagcgcggggcgacgctggctgcagggacccggtgacagcgtgagaggttcgcagagtgagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaac

SEQ ID NO: 174048 - DNA, 550 bp, Homo sapiens
  Payload ID: 14164
  Gene Symbol: RAP1B
  Gene Name: RAP1B, member of RAS oncogene family
  ENST ID: ENST00000538877
  CDS Start-End: 391-550
agccggagcggcgcggcagcggcaggaccgccgtggcgcctagagtagcgacccggggggagcgcggggcgacgctggctgcagggacccggtgacagcgtgagaggttcgcagagagctctcaacttaatcatccttcagcaaaaaagaattaagactagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttg

SEQ ID NO: 174049 - DNA, 734 bp, Homo sapiens
  Payload ID: 14164
  Gene Symbol: RAP1B
  Gene Name: RAP1B, member of RAS oncogene family
  ENST ID: ENST00000543697
  CDS Start-End: 132-542
gccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagag

SEQ ID NO: 174050 - DNA, 714 bp, Homo sapiens
  Payload ID: 14164
  Gene Symbol: RAP1B
  Gene Name: RAP1B, member of RAS oncogene family
  Uniprot ID: P61224
  ENST ID: ENST00000341355
  CDS Start-End: 156-710
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatata

SEQ ID NO: 174051 - DNA, 606 bp, Homo sapiens
  Payload ID: 14164
  Gene Symbol: RAP1B
  Gene Name: RAP1B, member of RAS oncogene family
  ENST ID: ENST00000534899
  CDS Start-End: 345-606
aggcgtgtaaaccagccggagcggcgcggcagcggcaggaccgccgtggcgcctagagtagcgacccggggggagcgcggggcgacgctggctgcagggacccggtgacagcgtgagaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagt

SEQ ID NO: 174052 - DNA, 509 bp, Homo sapiens
  Payload ID: 14164
  Gene Symbol: RAP1B
  Gene Name: RAP1B, member of RAS oncogene family
  ENST ID: ENST00000535492
  CDS Start-End: 201-509
gtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaact

SEQ ID NO: 174053 - DNA, 701 bp, Homo sapiens
  Payload ID: 14164
  Gene Symbol: RAP1B
  Gene Name: RAP1B, member of RAS oncogene family
  ENST ID: ENST00000541216
  CDS Start-End: 46-585
cccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgaggtatggtcaaatatacttaaaatgggtcttcatttgaagtacaacattgaagatgaatggaaaatgtcttaaccccaagttaatatgtactcagggtaatatgttgatgttacaggcaaaaaaaaaaaaccctcatgttaaatgtatctatgtagtaaataaacaatactatttcagtctctattaaa

SEQ ID NO: 174054 - DNA, 530 bp, Homo sapiens
  Payload ID: 14164
  Gene Symbol: RAP1B
  Gene Name: RAP1B, member of RAS oncogene family
  ENST ID: ENST00000453560
  CDS Start-End: 148-530
aggcgtgtaaaccagccggagcggcgcggcagcggcaggaccgccgtggcgcctagagtagcgacccggggggagcgcggggcgacgctggctgcagggacccggtgacagcgtgagaggttcgcagagttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaa

SEQ ID NO: 174055 - DNA, 587 bp, Homo sapiens
  Payload ID: 14164
  Gene Symbol: RAP1B
  Gene Name: RAP1B, member of RAS oncogene family
  ENST ID: ENST00000538980
  CDS Start-End: 223-587
cagattcaggcgtgtaaaccagccggagcggcgcggcagcggcaggaccgccgtggcgcctagagtagcgacccggggggagcgcggggcgacgctggctgcagggacccggtgacagcgtgagagactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgg

SEQ ID NO: 174056 - DNA, 591 bp, Homo sapiens
  Payload ID: 14164
  Gene Symbol: RAP1B
  Gene Name: RAP1B, member of RAS oncogene family
  ENST ID: ENST00000538283
  CDS Start-End: 288-591
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagaggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttc

SEQ ID NO: 174057 - DNA, 977 bp, Homo sapiens
  Payload ID: 14164
  Gene Symbol: RAP1B
  Gene Name: RAP1B, member of RAS oncogene family
  Uniprot ID: P61224
  ENST ID: ENST00000539091
  CDS Start-End: 151-579
gtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaag

SEQ ID NO: 174058 - DNA, 312 bp, Homo sapiens
  Payload ID: 14164
  Gene Symbol: RAP1B
  Gene Name: RAP1B, member of RAS oncogene family
  ENST ID: ENST00000485252
  CDS Start-End: 167-312
aaaccagccggagcggcgcggcagcggcaggaccgccgtggcgcctagagtagcgacccggggggagcgcggggcgacgctggctgcagggacccggtgacagcgtgagagaattctttttttttttttcctttaataaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcaca

SEQ ID NO: 174059 - DNA, 874 bp, Homo sapiens
  Payload ID: 14164
  Gene Symbol: RAP1B
  Gene Name: RAP1B, member of RAS oncogene family
  ENST ID: ENST00000543393
  CDS Start-End: 141-497
agattcaggcgtgtaaaccagccggagcggcgcggcagcggcaggaccgccgtggcgcctagagtagcgacccggggggagcgcggggcgacgctggctgcagggacccggtgacagcgtgagaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcacc

SEQ ID NO: 174060 - DNA, 561 bp, Homo sapiens
  Payload ID: 14164
  Gene Symbol: RAP1B
  Gene Name: RAP1B, member of RAS oncogene family
  ENST ID: ENST00000541167
  CDS Start-End: 283-561
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagacagggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgattta

SEQ ID NO: 174061 - DNA, 480 bp, Homo sapiens
  Payload ID: 14164
  Gene Symbol: RAP1B
  Gene Name: RAP1B, member of RAS oncogene family
  ENST ID: ENST00000541386
  CDS Start-End: 448-480
agccggagcggcgcggcagcggcaggaccgccgtggcgcctagagtagcgacccggggggagcgcggggcgacgctggctgcagggacccggtgacagcgtgagaggttcgcagaccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagaatgtaggagccttttattctcatgtaatgcccccaccctggaatccttgaagaccttctgtctattgttcatatactgaaattttataatgataagccttggtactaggttttgacaagcttgcatcatgcgtgagtataagctagtcgttcttggctca

SEQ ID NO: 174062 - DNA, 561 bp, Homo sapiens
  Payload ID: 14164
  Gene Symbol: RAP1B
  Gene Name: RAP1B, member of RAS oncogene family
  ENST ID: ENST00000489473
  CDS Start-End: 529-561
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagaccagacacggtggctcacgtctgtaatcccagcactttgggaggccaaggcaggcagagcactttgggaggccagggcgggcggatcacttgaggccagaagttcgagaccagtctggccaacatggtgaaaccccatctttactaaaaatatgaaaattagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctca

SEQ ID NO: 174063 - DNA, 1264 bp, Homo sapiens
  Payload ID: 14164
  Gene Symbol: RAP1B
  Gene Name: RAP1B, member of RAS oncogene family
  Uniprot ID: P61224
  ENST ID: ENST00000540209
  CDS Start-End: 146-643
aggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagatt

SEQ ID NO: 174064 - DNA, 5487 bp, Homo sapiens
  Payload ID: 14165
  Gene Symbol: RAP2A
  Gene Name: RAP2A, member of RAS oncogene family
  Uniprot ID: P10114
  ENST ID: ENST00000245304
  CDS Start-End: 250-801
tcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccaatgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtctttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaactctggatttgctttgttttgtacatgctcatgagagaaatgtattatatacaaaaacaattaaaaattgccatataatgaatttagtactcttcatacaaaaatattttagctgatttgagagttcatcatataaaaaggcaggtaggtagataattttcatagtctttaaaaataaaaataacatgtaagagactgtaaaatcagttattataaatataaacttatctctacaaatgattttatattttgaatggtagctggttaatttaaagcctgatgctaaggttaacagaattgttcaaataattaacattaattagcaatatcactaaaatgattcagaggccttctagtgatggcttgaagccgtctttctgttttcaggtcatgtggatccgaaggtgccagaagctgaaggttgccgccaggctgtagggcctgcttgttctatatggggccctatgaaagttgacagatgctgttaattgtatacagccttcagctgctctgataaggagcccattcatttcctaagccaatttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctcttaaatggatcattccaactggttttacatcgttgaatattatctagtatttttaataaatattttcataaata

SEQ ID NO: 174065 - DNA, 903 bp, Homo sapiens
  Payload ID: 14165
  Gene Symbol: RAP2A
  Gene Name: RAP2A, member of RAS oncogene family
  ENST ID: ENST00000476869
  CDS Start-End: 1-327
atgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggcctatgttgtaaaaagagttttaagtactctaagtttttttggagtaataagagtttgaatacgagcagactttcaaacaaggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttg

SEQ ID NO: 174066 - DNA, 4904 bp, Homo sapiens
  Payload ID: 14166
  Gene Symbol: RAP2B
  Gene Name: RAP2B, member of RAS oncogene family
  Uniprot ID: P61225
  ENST ID: ENST00000323534
  CDS Start-End: 425-976
gcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaatgtgatttatttcttgctttgagattggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttggtataccttaggtctatgaagtgtagctgaaatctgaagagtcttgacaaagggatttacacccttgacaaaaccaaaagaaattaacaggccacaggtttctttaaagctgtgttaacatatcttgccttaaaatgtgtgtgtgtgtttttgctttgcttttttttttttgcccaagaggcatctcagtactccagcaatggaggaagaatagagaattttgcctggcaatggtcctactgccattttttttttcccactctgatctcacttaagtttgatatcaaacacaattgggaggcaatagtatcaatatcctaaatgtagaaattaaaagatactgtataattttatgcctttgcaaagattcgttcttgtatttgaataaattcagttgctaaagtagatccaaagtgttaaaaatgctgaagtcatgtcaagtactgtctggagggtttttttaagaaaaggcatttggcatttaactgtctcttgttttatttttaagtttttggaaaccttttgacataaaatgctgccaagtatctaagaaatgtatatactgacagaagatatttgaaagtggaaaattggaaatgaaatatgttgctgggtgcgttaatcacctccgcccaggatttagtcacttgcaggacctctttatagtctaggatggcagagcagaagattttaatatgcttttattaagtgatgtaaaataaatgctttttggattatcaatgaaagcaattttatgtgtgcctgaagcaagaaaatagcgtttttggttttatctcatattttcttggcaaaattgagagaaattaggaacactgctatttttttcttaaaaatgtttttaagaatatgttcgtttctttgactattaagaaccccttgtggtattagtgtgtgaagagataagggcatttgtttcaatgaaaaagttagtgttaaaggaagtgagtcagggagggcggagtttgttgtaaggcaatcacctgtcaaaacagaaattgggtgggaaaggagtctttatcttggggagcaaaagctgacttttaaacttgacccctgctgtttttaaacagcttttccttttggtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatactaatata

SEQ ID NO: 174067 - DNA, 3896 bp, Homo sapiens
  Payload ID: 14167
  Gene Symbol: RAP2C
  Gene Name: RAP2C, member of RAS oncogene family
  Uniprot ID: Q9Y3L5
  ENST ID: ENST00000342983
  CDS Start-End: 748-1299
ggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 174068 - DNA, 2333 bp, Homo sapiens
  Payload ID: 14167
  Gene Symbol: RAP2C
  Gene Name: RAP2C, member of RAS oncogene family
  Uniprot ID: Q9Y3L5
  ENST ID: ENST00000370874
  CDS Start-End: 810-1361
cgctggagagatggcaccggcctgaggtcaaggagaaattgaactaaactctcctttgaagactgtttccagaggcccgttcccgaagccggagtcccgacccgaaaccgtccccggccggctcgctcgctcagcagggcgcggctccagcgccacccggctcgccccgaagagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagcccccaccctttccctcccgggggcacgcgcctcctcgccaccctcgccgggcttttcccaggctcgccctcctccccacgccccctgctcgggctgcagttcctataggaagggcattaccatcccttccccaccctccccgactctacgctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactt

SEQ ID NO: 174069 - DNA, 3341 bp, Homo sapiens
  Payload ID: 14167
  Gene Symbol: RAP2C
  Gene Name: RAP2C, member of RAS oncogene family
  ENST ID: ENST00000620646
  CDS Start-End: 390-743
tgatacgacacagggcccaggccagctggagccagagctggggacttcgctggagagatggcaccggcctgaggtcaaggagaaattgaactaaactctcctttgaagactaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctctctctcaaaattacagtgttcattgtcattgacctcagcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactgag

SEQ ID NO: 174070 - DNA, 1951 bp, Homo sapiens
  Payload ID: 14168
  Gene Symbol: RORA
  Gene Name: RAR-related orphan receptor A
  Uniprot ID: P35398
  ENST ID: ENST00000261523
  CDS Start-End: 90-1760
ccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagggatgaactttttgggattctccaaatactccatcagtgtatcctgtcttcaggtgatgcttttgttcttactggcgtctgttgttcctggaggcagaatggcaagccaccatattcacaaaaggaagataaggaagtacaaactggatacatgaatgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 174071 - DNA, 1908 bp, Homo sapiens
  Payload ID: 14168
  Gene Symbol: RORA
  Gene Name: RAR-related orphan receptor A
  ENST ID: ENST00000309157
  CDS Start-End: 71-1717
ggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcttcaacctgtagctccctgagcaggctgttctggtctcaacttgagcacataaactgggatggagccacagccaagaactttattaatttaagggagttcttctcttttctgctccctgcattgagaaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 174072 - DNA, 10844 bp, Homo sapiens
  Payload ID: 14168
  Gene Symbol: RORA
  Gene Name: RAR-related orphan receptor A
  Uniprot ID: P35398
  ENST ID: ENST00000335670
  CDS Start-End: 102-1673
ttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 174073 - DNA, 1701 bp, Homo sapiens
  Payload ID: 14168
  Gene Symbol: RORA
  Gene Name: RAR-related orphan receptor A
  ENST ID: ENST00000449337
  CDS Start-End: 125-1531
tctcggcgggcgggcagctgcggcagctgctgctgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataa

SEQ ID NO: 174074 - DNA, 749 bp, Homo sapiens
  Payload ID: 14168
  Gene Symbol: RORA
  Gene Name: RAR-related orphan receptor A
  ENST ID: ENST00000551975
  CDS Start-End: 1-188
ccccgctgaaccaggaatccgcccgcaagagcgagccgcctgccccggtgcgcagacagagctattccagcaccagcagaggtatctcagtaacgaagaagacacatacatggcaggcatggtacagagcgcttccttgcacagccttgcccatgagctcgtccctggcccggagggacccactctagaggtgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatc

SEQ ID NO: 174075 - DNA, 577 bp, Homo sapiens
  Payload ID: 14168
  Gene Symbol: RORA
  Gene Name: RAR-related orphan receptor A
  ENST ID: ENST00000559343
  CDS Start-End: 118-577
ctctccagaaagacttcggaggagcttactccactccccggacggtcccagtggcttcgttctccacggcccagaagtgggccgtaccttccgattagagctggggcactctaggaaatgcgggtgaccgtagctccccagaccaaacctgtcttttccaccaacgagctggcgcatttatcgcccccgagtgctccggcaagccagcgggagagtggcgtcgggttgcgagcctcttgccccaccgagtgggggcagaaagtggtcagaggcgcgttccgcggggcgctgcgtgcagaaaagcgaccggcggccacagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagc

SEQ ID NO: 174076 - DNA, 492 bp, Homo sapiens
  Payload ID: 14168
  Gene Symbol: RORA
  Gene Name: RAR-related orphan receptor A
  ENST ID: ENST00000558904
  CDS Start-End: 1-117
gcggccgccggctccagggagaccccgctgaaccaggaatccgcccgcaagagcgagccgcctgccccggtgcgcagacagagctattccagcaccagcagagattggcatgcttaaagggctgaccatctgatgtacaggaaatggaaactactctctgaaaagcaagtgatctcccagccgcacccatttaggagaccaggattttattttgatccacaggagactaaatgagttagaggccactcctgtatcaacagagtttgttacttaaatgacagtagggcggttcgcagaaggaacaccaaatagtctgactatctaccaagaagagagtgtttgaacacatgtgcaacctcttgactgtggtgtgtggggcagcatttaataagaaagagctaaatctgcttgatgtgggaatatattcaacacatgttaagtgctaaaatattcaaagtaaataaatgtctatgtactccatattgttaaaga

SEQ ID NO: 174077 - DNA, 9551 bp, Homo sapiens
  Payload ID: 14169
  Gene Symbol: RORB
  Gene Name: RAR-related orphan receptor B
  Uniprot ID: Q92753
  ENST ID: ENST00000376896
  CDS Start-End: 613-1992
cccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcccttcctcctcctcctcagtccaagtgatcacaaaagaaatcttctgagccggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgagcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaagagagaagtttgtgtataagacaatgaaaattatggtctcctgtaagtatatcccagccaccaactcctaaagaactgcccttttctccatattaaacacacacacacttacacacacacacatacaaacccctgctttgtaaagtttccatcagtggaaactttgatttctttttttaatctcttatgctctcctgaagttcatggttgagcaccatctccaagataccacagaactcttgattgatgatcaaaacagtagtgtcatcttttccttttagaaaacggaacattttctcacctcatgattgatgaattctaaaccaatggggaaaaacaaaaaggctttaaaataatgaatctgtttctcaactactgttatattcaattaatttaactacattgaaccaaattacctttggttctaagaagacagctgtagactgcttattatgctgctacagggactcaattctttttggtgtaaatgtcactcctgctagctctttgtataaagaattaattcccagagtcatatttccttctaatggaaagattactctactgattgctaggaaaacagggtaatggaaggcactcaattaaaccaagccgtttccaaatgcaatgtatgttttatgattggcttgtgataggcgatgcttcatgtgtctacttggtgtttccctttgagctttgaacttatgtcaaactttgttttcattgttctgttggcctagtgttttccattgtcagcctgtaattcctgctcagttgcagagggaattatttatttcctccaatttaccttagaggatttaaattggctcaattgatgaagtggctcagaattttttcctcccttttcccatgggtgatataggaaaaagattgttccccacatttaccttgggaggtactgctttgaatttgtgttgtttccactagcgttaagcatttcactgggacggcatggaccttttgaagctgggaggaaggaaacagagctagcatctgaaccagagcaaaacaatggcaaccaggacatactcatcccacttagttgagagaagagatttctagtttgggttacagttgcccaaccttccctttaaagagaatccagtcatgttttcaatggtaaaaagccttaaaaagctgcccttcgaagatctcctatgactgcatgtcaaggtattttgtacctacaatcccagaacttggttccttccccatgaggactaacaaatgttcacaacaatcatgatcaagtgtgcactggaagaaaaaatccacaatctgggcttctcacttcgtgcttcataaatgacaatcactgcttgatgcagatgttgcactgtatccactcagggatgtttccttaaaaaaaaaaaatacatcaagaaggaggaaaaaattaaaaacaggaaaatgacaacaaaatgtgaatggtataaattaaatatgttgctgagagcacctctctgacaaggctttcagaccaacaagcagtaacttcatgtcataaactagattgacttatttggacttgctgaaaagttgcacccaagtaaggacaacttggtctcattttctaaactctgctaagagccaaataatctagctgtcccattcagaggaatttttatctccctgcaaatccaaactttctatacaaatcctgaacaaggaaaatacagaaatctaactggcattagataaaatggacaagggaggtgaaaccgggtgaattcaaacttcagtgtatttgtggtccataaaaagaaagggaaattttggagggaaaataggacaggaaaggattccaaatctggtttgacacccgtatatgcccgtactgtccatgactcaactaatctctttgcccctttttctgtggctccttttttgttttgagacagatcttgttcaacatgttgctcaggctggagtgcagtggcatgagatcttggctcgctgcaatctctgcctcctgggttcaagcgattctcctgcttcagcctcctgagtagctgggattacaggcacacgcccccacacccggctaatttttgtattttaggtagagatggggtttcaccatgttggccaggctggtcctgaactcctgacctcaagtgatccacccgccttggcctcccaaagtgcaaggattacaggcctgagccactgcgccctgccttcagtggctcttttatcccccaaagactgaaagctgaaggtggagatgttctccacaaacataccctttctgaatttcccttgttttagcactgtgttcagggctctggactaaagtacctctgagtaggtaaaatcagagaatataacgatctcctgagtgattagatttctttggtagattccaagagatcttaaatcataataaactctgaatattaacaagaggtgccagggaggtgtcagtacatttcctatcatagctgccttgttcaaagcataatctcagagcagtcaagctaaactgtttgtagaaaaccatgaagatcaactcatgctcactctctacaatgcaatgtgtacgaggcttgaaggcaaaaacaattcttgggtcccaaggacaacctaaaacttaccagcttttttcaaaaacaacaatcagatgcaaataatggcagtgttgttctatgttctttgtttctgttcattatagaagcaaggaaaaattctatttctattggaaattagaagaaataatttcttcctgactctttttttttctataaacttttatttccaaggaagctgctacaatttgcagtcaattcaggccatggacgtctgtgccctaacagaagcaccgttcaatagaacagcaataaccttaaagtgtgcatctgtagtgaaactctgcacaaagtcccctgcataaagaagagaggaaagcctaccatctgctttagacgaagtgttatttgatgttctgtttccaactgtcagtataagcagcaactagagtaaaggcctgatgtgggaaactatggggggtctttcaaaaaaaagctgacactctattcatttttgggtctcaggaccagagggtacagggtagagggtagtttaccatttaaagcaggggttgaaaattcgaaagcctaaaagggccagggggcttaatgcaaatgggtgaagcagcccaggggcaagctggccaggaaatgccctgtggaaaaagggacatccacgatttacctgaaactgaatgctgctagagcttctgaattttataaaatctctgaaattatacatgatggcagttgattcagagcttagtgcagaccaaacaaatacatcactgagcagaagagggcccatagatcgtcagcttgcagcctctggtttaaagcaaaatcgcatctggggccagctcaactgcagcaagtctggtcagattcaaccctggacgatattagaatgatattagttttggaaggaggggatggagatcttccccttctaatactcaattttgttttggtatttgattgtcacaactagaggatataacaggaggtcagtttaaaaaatagcaaacagtctaaaaatgaaaactattcaatttagtgatggcttataaaagacactccaacttgtcttgcccaaactcccttcttcatagagccagggggctggatttcttgccactttttttctgaaaggcaaatgcatgacttttattcttttgggtctcagtgtgtttcttgaactgtgtgacttcaatatctgtgacaagtttttattttcccttagttgtatgtgaagaatttattctatagtcgtgatcatgtagtcctccattgtttggaagtgcagaccatggattcctatgcagcagatgggggttgtctgtttgtgcacttttttcctaagctgctgaaattcctccgatgtgaatgggccatagtaatctttgcctcctgcgtgactgtaagcatggcctccagtggatcagagaaagcagctcagtgattgttctcatggccaaaaataaagcacaagggttaccggaattgaatgagccctgttcagggcagcacggggcatctgcaccccagctgggcagcatgatccttgtattcaactatactcttctggcagtagttggtggcaagcattcgcgtgcctctgtcacaaccatacgtagaaacacattaggtatgtctggaaagctacaaatcccacatccaagcacagtaccgtctgcttcatctgattaacacacacacaagaaagaaaaattacacccacagaaaactgagtatgtattgtagaaatgtagaggaaaaataaaaatattttttcaaatgtaattacttttaatatatgcttgtggaaggtctaatacaatgtatgctgtctctgtaatttttgctgtaaataactggagacggtgagtacactgatttttctatgtctctgtttaagcataagactttgtaacaatttttttagagggggaaaatcaacaaagagcaaatatgtacttgcttcctttctgcgtgttatgtacttctcagttttttaatggaaactggttgtaacagtttaagcatcttgacgggtcattggtgttaagtgtatgcttctttttgtaatatgactgagaaagggacagggctgtcaattaaatctgctccaaagaatttgtattgaagattggcctaagacctgcaaactccatctataactagaaaatacgaaaaaggaaaattaaaaaaaaaagttgcctgagttaagtcatctttccttgtagcaaatggctttgtccaaatcctttctgcatggaatagcttaaggaaaacaaactccgctttctgatgaacaagatatttttgtacacatttatttcttgttaataacctgaggtcagaccactcatttgctgaagccataactgaccttcaccaaataaatgttgtaaagaacctaggggagggttggggagagactgagagggaggaaaatccaaggtgtcatgagctatagcaacacaggcaggagcaagttgttgaaactgatgcttttcctgcatcccaaatatgactttaaaaggctagtattttatgatgatcgatttataatgataaaaagatatttagatttaaatgagacattccaatatttttgaaatccctaacaatgcttccttgcttttaggattgagagaaatgattttcatatacttccaacattcagagatttaatgtttttaccttagctccagcctacgcttgtaaagtgaagagtgattctaagtcccgtgaaaccgtgggctgcctggggcttggctgtgcccactaacctactgcgcctggggggcagcatgggaggggtacagtttgcatctcattagcatgcacaccactgttggcaatgcataaaagttgcattgccacaagtatgtaaaataaaaatattcactctaaaaagaataataattctacttttttaaaagaataatgtctcttatagtcaccattgatttttctggagtttaattacattattaccatgtattcttattggcctgtagaggaaaaaggcaaaccacaaataaacccagtgacatatatagttttaaaatctacaattttctgatctctctctccttgtttaatatataagccctaatttctgtgtatgtgagtaaaactgcagcctgagtcatttaggaagtaagtattgagtttttttaatcataaatatactagaataaaacagcactccctaacaattaaaaaagagttttatattactttagaatgtaataggtttttgtccttattttatgtcctgtaaattattagttcaatactgttagcattcccggataatgcacacatgatttctgaatgttttctgtaaatgacaatcaatgtttatgaagtttcctcctttaatgctgaacaaaattaaaagaagaaaaagaaaaaa

SEQ ID NO: 174078 - DNA, 2996 bp, Homo sapiens
  Payload ID: 14169
  Gene Symbol: RORB
  Gene Name: RAR-related orphan receptor B
  Uniprot ID: Q92753
  ENST ID: ENST00000396204
  CDS Start-End: 1-1413
atgtgtgagaaccagctcaaaactaaagctgacgccactgcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaa

SEQ ID NO: 174079 - DNA, 2180 bp, Homo sapiens
  Payload ID: 14170
  Gene Symbol: RORC
  Gene Name: RAR-related orphan receptor C
  Uniprot ID: P51449
  ENST ID: ENST00000318247
  CDS Start-End: 109-1665
gccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttaca

SEQ ID NO: 174080 - DNA, 3050 bp, Homo sapiens
  Payload ID: 14170
  Gene Symbol: RORC
  Gene Name: RAR-related orphan receptor C
  Uniprot ID: P51449
  ENST ID: ENST00000356728
  CDS Start-End: 156-1649
agaagcactgggggagagagctaggtgcagagcttcaggctgaggcgctgctgagagggcctcgccccgcctctgccgccagctgcaccccactcctggaccaccccctgctgagaaggacagggagccaaggccggcagagccaaggctcagtcatgagaacacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaa

SEQ ID NO: 174081 - DNA, 1923 bp, Homo sapiens
  Payload ID: 14171
  Gene Symbol: REM2
  Gene Name: RAS (RAD and GEM)-like GTP binding 2
  Uniprot ID: Q8IYK8
  ENST ID: ENST00000267396
  CDS Start-End: 124-1146
atgtgtgtgtgtcgggggggggggtggtatttaaagggaaaagctgacagtgctgctgagtgagggagagggtgctgcgagctgctgggctgcacacgcacacgcacacgcacacgcacactgatgcacacggacctggacacagacatggacatggacacagaaaccacagcactctgcccctctggcagccgccgggcctcccctccagggacgcccacaccagaagcagatgccacgctactaaagaagtcagagaaactgttggcagagttggaccggagcgggttaccctctgcccctggggcccccagacgaagaggcagtatgcctgtcccctacaagcaccagctccggcgggcccaggctgtagatgaacttgactggccacctcaggcctcatcctctggctcgtctgactccttgggctcaggggaggcagcccctgctcaaaaggatggcatcttcaaggtcatgctagtgggggagagcggcgtgggcaagagcaccctagcaggcacttttggtggtctccagggagacagtgctcacgaaccggagaacccagaggatacctatgagagacgcatcatggtggataaggaggaagtgactctagtcgtttatgacatctgggaacagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggaggagggccgccacctggccgggacgctgagctgcaagcacatcgagacgtcggccgcactgcaccacaacacgagggagctcttcgagggcgcggtgcgccagatccggctgcggcggggccgaaaccacgccggaggccagaggcccgatccgggcagccccgagggccctgcgccacctgcacgccgcgagagcctcaccaagaaagccaagaggttcctcgccaacctggtgccgcgcaacgccaagttcttcaagcagcgctccaggtcgtgtcacgacctctcggtgctctgagccgcggtcgccatggccactgcggtcgccatggtcaccgcgccctccgctcgccccccctcgccccgccccgcccccgtccggcttccttggtggaggccgtctaggaaaccaaaaactcccaggatgccccggtgtgaccgccgggggcggcccggggccgctcggcggcacctccacacccgccccaacgcgttctctggagctttgggcctcagggcgcctagaaggcgaggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctttaaggagttcttaaaggcaagggcctggaagtgctgttcctgagatggattctcttgacttaccagtccaccacggcacttcccctttaaggttattaaaggtaaggggtggacagactttctgcattcagataatgagcagtggcaaccccttttggccagggccaggggggcaccagcaaggggccaccctttcccttttcaataaataatttttgtactgcctctgttca

SEQ ID NO: 174082 - DNA, 1331 bp, Homo sapiens
  Payload ID: 14171
  Gene Symbol: REM2
  Gene Name: RAS (RAD and GEM)-like GTP binding 2
  Uniprot ID: Q8IYK8
  ENST ID: ENST00000536884
  CDS Start-End: 67-732
gagtgagggagagggtgctgcgagctgctgggctgcacacgcacacgcacacgcacacgcacactgatgcacacggacctggacacagacatggacatggacacagaaaccacagcactctgcccctctggcagccgccgggcctcccctccagggacgcccacaccagaagcagatgccacgctactaaagaagtcagagaaactgttggcagagttggaccggagcgggttaccctctgcccctggggcccccagacgaagaggcagtatgcctgtcccctacaagcaccagctccggcgggcccaggctgtagatgaacttgactggccacctcaggcctcatcctctggctcgtctgactccttgggctcaggggaggcagcccctgctcaaaaggatggcatcttcaaggtcatgctagtgggggagagcggcgtgggcaagagcaccctagcaggcacttttggtggtctccagggagacagtgctcacgaaccggagaacccagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggagggtgtgtatcctgaacagattccatacttgcgatctcaggggaatgctctcccttccaagtcacctcttctccctaaggcctttttaccatcgcggacgcactcacttgcaatcagacccaggctagggggacactcccaatgccccactcgaggatcctgagaatcccttcttgtcacttcccctcacctctctcctaggcctccttctccctctccttcgcacctccacagacccaccatatgagctcagccatgttctctcggttgcaagattcactagtaccaatcccttgccaccgcacgcccaggccctccctagacccaccctcgccccgggtcccgtacagcccagcgggcgcctgagccggtgccttcctgcagagggccgccacctggccgggacgctgagctgcaagcacatcgagacgtcggccgcactgcaccacaacacgagggagctcttcgagggcgcggtgcgccagatccggctgcggcggggccgaaaccacgccggaggccagaggcccgatccgggcagccccgagggccctgcgccacctgcacgccgcgagagcctcaccaagaaagccaagaggttcctcgccaacctg

SEQ ID NO: 174083 - DNA, 1665 bp, Homo sapiens
  Payload ID: 14172
  Gene Symbol: REM1
  Gene Name: RAS (RAD and GEM)-like GTP-binding 1
  Uniprot ID: O75628
  ENST ID: ENST00000201979
  CDS Start-End: 294-1190
ctgaggcgggtggtacagcctggagcatccagccgctggagctgcgagggaccctggacccctcccacgccgaggtttatgcagagcctgaggccagaaaacctagggactttctgccccaagaagctgaggcacctcctactcccatctgaacaagagggggatctggaagaagccatacagcagctcatcaggacactatagaaagaagcagctcaaagcaattggctgacagccaattcccccttctttcagaaggaaagaaggaagaagcaaacccccccctaccaaagatgacactcaacaccgagcaggaagcaaagacccctctgcaccggcgagccagcaccccactgcccctgtccccacggggccaccagcctggccgcctgagcacagtgccttccactcaatcccagcatccccggctgggccaatcagcctccctcaaccctcccacccagaaaccttcacctgccccagatgattggtcttctgaatccagcgactctgaaggctcctgggaggctctctaccgtgtggtgctacttggagatcctggagtggggaagaccagcttggccagcctctttgcagggaagcaagagagggacctccatgaacagctgggagaagatgtatatgagaggaccctcacggtggatggagaagacaccacactggtggtcgtggacacctgggaggccgagaaactggataaaagctggagccaggagtcatgcctgcaggggggcagtgcctatgtcatcgtatactccatcgcagaccgaggcagctttgagagtgcctctgagctccgcatccagctgcggcgcacacatcaggcagaccatgtgcccatcatcctcgtgggcaacaaggcagacttggcccgctgccgagaagtctctgtggaagagggccgcgcctgcgctgtggtgttcgactgtaaattcatcgagacatccgccacgctgcagcacaatgtggccgagctcttcgagggcgtggtgcgccaactgcgcttgcgccgccgggacagtgcggccaaggaacccccagcaccccgacggccggccagcctagcccagcgcgctcgtcgcttcctggcacgcctgacagcccgcagcgcacgccgccgggcactcaaggcccgctccaagtcctgccacaatctggccgtgctctgaagccccccgcccttctgagagttggcgggtcactgaggtgcattctgggctccagggacgccactgcggggcaaaggcgccgttacctggagtctgcatcatgggtcttgcttgcctgctgccctgatggcctgagcatcccccagatccaagcctgggggatcccgggaaagcgatggacagacagacgatggggccgaagccccaagctgggcacaaagtagttttttacgtggtgggtgtctttttgtaaaaaaatcttccttgtccctgggctctggccaaccctcagaaaccctcacaataaaccagaccagaaggatgtcccatctgaatgcccagacctctccatctcggctcttccaggcgtctccacctactgccctcccatctacacttgactgtagactggtctggcctgctggcctgggcgtcagggcgcatcaataaagtacttggaccagttttgtgctca

SEQ ID NO: 174084 - DNA, 1765 bp, Homo sapiens
  Payload ID: 14173
  Gene Symbol: RASEF
  Gene Name: RAS and EF-hand domain containing
  Uniprot ID: Q8IZ41
  ENST ID: ENST00000340717
  CDS Start-End: 311-880
aaagtggcgagagccacctcggcgcttgggcgctcagtcgcaggaggcgctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagatttggctacacaatttcaaaacctgcatttgtgttcgtgaggcatctcataacactgtgtgcattgtcatgggctaaaaaggaaggcagagaaacactttggacaatcgaggagggaggagccaagatggccgaataggaacagctccggtctacagctcccagcgtgagcgacgcagaagacgggtgatttctgcatttccatctgaggtaccgggttcatctcactacggagtgcgagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacaagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagcctggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagatggagatctgagaacgggcagactgcctcctcaagtgggtccctgacccctgacccccaagcagcctaactgggaggcaccccccaacaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatgggg

SEQ ID NO: 174085 - DNA, 5576 bp, Homo sapiens
  Payload ID: 14173
  Gene Symbol: RASEF
  Gene Name: RAS and EF-hand domain containing
  Uniprot ID: Q8IZ41
  ENST ID: ENST00000376447
  CDS Start-End: 262-2484
ctccttggcggtgcctggagcccgggcgcaccccaccgctcccgggacctgttgggggctggcccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgcccccgccaggcgggatggaggcggatggggacggagaggagctggcccggctgcgctcagtcttcgccgcctgcgacgcgaaccgctcggggcgcctggagcgcgaggagttccgggcactgtgcacggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgccgtgtctgaggcggggccggagacacacgacagcgaggaggacgaaggcgacgaggacgcggcggcggcgctggccacctcgtgcggcccggcgagtcccggccgggcttggcaggatttccaggcgcgacttggggacgaagccaagttcattcccagagaagagcaagttagtaccttgtaccaaaacatcaaccttgtggagccaagattaattcagccatatgaacatgttataaagaacttcatccgtgagatcagacttcaaagcacagaaatggaaaatttggccattgcggtgaagagagcccaggacaaggcagctatgcagttgagtgagttggaagaggaaatggatcagaggattcaggctgcagaacataagacacggaaagacgaaaaacgcaaagctgaggaagccctcagtgacctcagacgtcagtatgaaactgaagtaggagatctgcaggtgaccattaaaaagctaagaaagctcgaagaacaatcaaaacgcgtaagtcaaaaggaagatgtggctgcattgaaaaaacaaatttatgatttatcaatggaaaaccagaaagttaagaaagaccttttagaagcacagacaaacatagcctttcttcagagtgagttagatgctttgaaaagtgattatgctgatcagagtctgaatactgaaagggatctggaaataatccgagcatacacagaagatcgaaatagtcttgagaggcaaattgaaatactccaaacagctaaccggaagctacatgacagtaatgatggccttagaagtgcccttgaaaacagttatagcaagttcaacagatctttgcatataaataatatctcaccagggaatacaatttctagaagcagtcccaaattcattggtcattcccctcaacctctaggctatgacaggtcatcccgctcttcctatgtggatgaggactgtgactccctggccctctgtgatcctctgcagaggacaaattgtgaagttgacagcctgcctgaaagctgcttcgacagcggcttgtctaccttgagagatcccaatgagtatgactcagaagtggaatacaagcaccagaggggatttcagaggtcacacggggtgcaggagagctttggaggtgatgcttcagacacagatgttcctgacataagggatgaagagacatttggtttagaagatgtggcttccgtcttagactggaagccccaagggtctgttagtgaaggcagcattgttagttcatcaagaaagcccatctcagcactctcgccccagacagacctggtagatgacaacgctaaatcttttagctcacagaaggcttacaagattgtacttgctggggacgctgcagtggggaagtctagtttcctcatgagactttgcaagaatgaatttcgagaaaatataagcgccaccctgggagttgatttccaaatgaaaaccctcattgtggatggagaacgaacagttctgcagctctgggatacagctggtcaggagagattcagaagtattgccaagtcttacttcagaaaggcagatggtgttttgctgctgtatgatgttacatgtgagaaaagctttcttaacatacgagaatgggtagatatgattgaggatgcagcccatgagactgttcccattatgctggtaggaaacaaggctgacattcgtgacactgctgctacagagggacaaaaatgtgtcccagggcactttggagagaaactggccatgacgtatggggcattattctgtgaaacaagtgccaaagatggttctaacatagtggaggctgttctgcaccttgctcgagaagtgaaaaagagaactgacaaggatgacagcagatccattaccaatctaaccgggaccaattccaaaaagtcaccacagatgaagaattgttgcaatggctaaatcccaaacatccttggcctgtgaagtcttcatttccagaatactgaatttgtgtgacttatttggctcttaacagagtggcacatcctactgacactgtcctatggagagttacagtgcaggaaacctgaacccagctctcaggtccctctggaactttggctcttctttgttttgtctcagtgagtgatttgggccctctggctaaatagactagtcatgtccttacaggtcttaaaagataacatgtaaatgtttttaaaatggtaaaaaaaaagaaaagaaaagaaatcacatgctcagatcaaagctgtagaggaaactgacataattagattcatgtggtagctgaattaggttacccacaaagtcagcatttaaatatttgatactaaagttctagtaagaagggattctcatcctagctttgctgttaactggccttgtgaccttggacatgtcacaagcccatgtcggatctgtttcttcatctgtaaaatgtgcagcttgccctcaaaggccttgcagcccttggcacctcagattctgtgggaagcagtaggacagagagtgtggtggcccacagttaataatagaactatggttattcctgctttttaatattggagtattgatttttctcacttctgaaataaggacagaatttgattaaaaaatggaaacagaaatatctattttttatgtataaagaaacatgtttgagacaaaaatagttgtatataaaaggatatttcataatctcagaatagttacaaagctcactgcttgaatttggtgttaaaaattctaatggaaacatgtaaagccacatactactgaaagcacaatgcccaggaaagttgtcactcttcacttaagggagtggttgccaggggctgagaaagggaggatggggagtgactgctaataggtatgtggtttctttgggcgatgatgagaatgttctggaattggaatagtggtgatagttgtataactgtttgaatgtactaggaaccactgaattgtatactttgaaagggtgaattttatggttgtgaattatctcactaaaaaaaatgctagtacttagagtgatgtaacattttgcaaaattttcattttcgtatccctgctgatttcaaaccttcccatggtttagaagcataacctgtaatgtaatgcaagtcccctaactccctggttgctaacattaacttccttaagtaataatcaatgaaagaaattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccactgagatgcctctaagagccaaaggagtcaacacttgagcctagggtgggctacaacaaaagattctaatttaccttgcttcatctaggtccaggccccaagtagcttgctgaaggaacttaaaaagtagctgttatttattgtattgtataagctaaaaacatttatttttgttgaatcgaaacaattccatgtagcaatcttttttctgttcacggtgtttgtgatagaaccttaaattccgcaagcatcagttttttgaaaaaatgggaattgaccggatagttacaggcaaagattataaatagctacaacatcatttaacttttataaacatgccttctctctattgaagacatctgatatttttgctggaaagttggatctatcctcagtaactctgccatgaattcctgtttcctggttccagaaaaagaaaagattacatttctgatcataaagaatgtcttgcatatgggaaatttttcaaaataaggggggtattatttatgtggcatgggaaaacttttgccatggctgtttgtcttagtggcatcttttgatgacattggatcagatatatgtagatgctgatatatgggacacatgtttaggttttggtgcagttgcacaaaactgtgttagtttatatgttactgtgttgcctttatttattctctccaaagtgtctctttatatttgttttacaatctgtgaaagagtataccataatacagaagtattttcatagtctttacctctggattgtcctgtcagtatagccacgttgatgagattacaccagtgcctttgatggtcaaccaatcatctttaagtatttgagccctgataaatattttggtaacataatccaaattagagacttagagctctggttagcaatcatgtttaaagagaagcttcttaaagctctgtatgctgggagattcatgattattaccaacgttttgatttcatgaaggtgttctcaaatttaaagcacattttcagtaagaacaaaaatatttaatgtttttatcttagacttgatacatttgcatattactatggaagttattcaccttgtccctgtttttctttaagatattttaaaatcatagttatactacagtccttttttaaatgtatcctgatacattgtaaaatattttaatttcattgtggaaaataatgttggataaggagatatttttcactgttaacttttagcccatgcattttcataatttatttttttcacttgctgctttatatgacatatgtgacatttgattatttaacacttgatgtgatctgcataaacccaagttgcacaaccctcctgctgaagataaaattgaggttaaagataaagatttattttcatatttgtacagtgatcggcttcagtgatggtttttgtgggcatttattgtgtgtgtgtaagaaatttcatatgtatatattaagtaggcctctgagtattgaataattgttttatgattttgatttatatggtttacattttcattgtgtgggccatatttcgtttatactgtttatttctcttcaaaccttaataattataccataaagtgtaatttttatagcaatgcaaatgtctaaggaactacaaatattttctacgttgtaaattcaataaagcttgcttcctttggcctttt

SEQ ID NO: 174086 - DNA, 2693 bp, Homo sapiens
  Payload ID: 14174
  Gene Symbol: RIN1
  Gene Name: Ras and Rab interactor 1
  Uniprot ID: Q13671
  ENST ID: ENST00000311320
  CDS Start-End: 128-2479
gtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagccagcccaggacccactgtatgacgtgcccaatgccagcggcgggcaggcaggcgggccgcagcggccggggcgcgttgtgagcctgcgggagcgcctgctgctcacccggcccgtgtggctgcagctgcaagccaacgcagcggccgcactgcacatgctgaggaccgagcccccggggacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctcttcctgtacaaggagcagggctaccaccgcctgccccctggggccctggcccacaggctgcccaccactggctacctcgtctaccgccgggcggagtggcctgagacccagggggctgtgacagaggaggagggcagtgggcagtcagaggcaagaagcagaggggaggagcaagggtgccagggagatggggatgctggggtcaaagccagccccagggacattcgggaacagtctgagacaactgctgaagggggccagggtcaagcccaggaaggccctgctcagccaggggaaccagaggcagagggaagccgggcagcagaggagtagcttgaagtggccagaagggtcattcggggcgggagaccctgagcctgctgagaaatccttttagcgccagcaagccccacccagggccctgtcctgtgtctgccaccacctttgtctgatacttgtttccagggaagctgggggaactgccacatctgaggaactggaataaagatgagggggcttcgggggcccccagactgtgtgcccaagg

SEQ ID NO: 174087 - DNA, 1872 bp, Homo sapiens
  Payload ID: 14174
  Gene Symbol: RIN1
  Gene Name: Ras and Rab interactor 1
  ENST ID: ENST00000530745
  CDS Start-End: 35-277
ggattctcttcctgaagcgaaggagctcccagccatggaaagccctggagagtcaggcgcgggctctcctggagcccccagcccgtccagcttcactactgggcacctggcgagagaaaaacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctc

SEQ ID NO: 174088 - DNA, 1834 bp, Homo sapiens
  Payload ID: 14174
  Gene Symbol: RIN1
  Gene Name: Ras and Rab interactor 1
  ENST ID: ENST00000534824
  CDS Start-End: 1-221
ctctctcaggcgtctccttggagggctcggagctcatgttcccagacctagtccagctcatctgtgcctactgccacacccgctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctcttcctgtacaaggagcagggctaccaccgcctgccccctggggccctggcccacaggctgcccaccactggctacctcgtctaccgccgggcggagtggcctgagacccagggggctgtgacagaggaggagggcagtgggcagtcagaggcaagaagcagaggggaggagcaagggtgccagggagatggggatgctggggtcaaagccagccccagggacattcgggaacagtctgagacaactgctgaagggggccagggtcaagcccaggaaggccctgctcagccaggggaaccagaggcagagggaagccgggcagcagaggagtagcttgaagtggccagaagggtcattcggggcgggagaccctgagcctgctgagaaatccttttagcg

SEQ ID NO: 174089 - DNA, 2122 bp, Homo sapiens
  Payload ID: 14174
  Gene Symbol: RIN1
  Gene Name: Ras and Rab interactor 1
  ENST ID: ENST00000530056
  CDS Start-End: 216-2069
gttcaggaatgagtcatctatggacagtagagggtgctctcccacaaggctgacctgaggccaggggcagatgagcaactgaccacagagccaaaggtgcccccagagcatggctggggcctgtggggactgaggccgcttaaccacttcccgcccacgtgtgcaatacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaagcctcgattgccaccctgaaccagctctgtgccaccaagttccgagtgacccagcccaacacttttggcctcttcctgtacaaggagcagggctaccaccgcctgccccctggggccctggcccacaggctgcccaccactggctacctcgtctaccgccgggcggagtggcctgagacccagggggctgtgacagaggaggagggcagtgggcagtcagaggcaagaagcagaggggaggagcaagggtgccagggagatggggatgctggggtcaaagccagccccagggacattcgggaacagtctgagacaactgctgaagggggccagggtcaagcccaggaaggccctgctcagccaggggaaccagaggcagagggaagccgggcagcagaggagtagcttgaagtggccagaagggtcattcggggcgggagaccctgagcctgctgaga

SEQ ID NO: 174090 - DNA, 243 bp, Homo sapiens
  Payload ID: 14174
  Gene Symbol: RIN1
  Gene Name: Ras and Rab interactor 1
  ENST ID: ENST00000627248
  CDS Start-End: 1-243
atggaaagccctggagagtcaggcgcgggctctcctggagcccccagcccgtccagcttcactactgggcacctggcgagagaaaaacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctag

SEQ ID NO: 174091 - DNA, 4505 bp, Homo sapiens
  Payload ID: 14175
  Gene Symbol: RIN2
  Gene Name: Ras and Rab interactor 2
  Uniprot ID: Q8WYP3
  ENST ID: ENST00000255006
  CDS Start-End: 150-2984
ctttcagtggtgttgttgaaagggcttggcagctcccaaatgtttgcagtgtccttagtcctatgagggctgccttcttcttcttcttcttctttttttttttttttttttgctagcttttagctagtatctggaaacatctactggacatgttggactcattttctcaagaatccactttacccttcagggaagccaggaaaagaacaagcttccaaccggtacaagtctggaggaatttcacagcctctcaaactacggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatcc

SEQ ID NO: 174092 - DNA, 1837 bp, Homo sapiens
  Payload ID: 14175
  Gene Symbol: RIN2
  Gene Name: Ras and Rab interactor 2
  ENST ID: ENST00000440354
  CDS Start-End: 37-1425
gagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttcct

SEQ ID NO: 174093 - DNA, 3859 bp, Homo sapiens
  Payload ID: 14176
  Gene Symbol: RIN3
  Gene Name: Ras and Rab interactor 3
  Uniprot ID: Q8TB24
  ENST ID: ENST00000216487
  CDS Start-End: 160-3117
aggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtgctccctgctcttgcccccgcccctgcctgtcctttgcccacctctcccccagtgcctgccccccacgtcacaccccatgccccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaatga

SEQ ID NO: 174094 - DNA, 2814 bp, Homo sapiens
  Payload ID: 14176
  Gene Symbol: RIN3
  Gene Name: Ras and Rab interactor 3
  ENST ID: ENST00000555589
  CDS Start-End: 141-620
gagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgaagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtgctccctgctcttgcccccgcccctgcctgtcctttgcccacctctcccccagtgcctgccccccacgtcacaccccatgccccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtgga

SEQ ID NO: 174095 - DNA, 4079 bp, Homo sapiens
  Payload ID: 14176
  Gene Symbol: RIN3
  Gene Name: Ras and Rab interactor 3
  ENST ID: ENST00000556418
  CDS Start-End: 1-1261
cacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggtgaggcctgagagcgggaggggcccggtggggccatgtcccagacaccatccctgctgcctgctggctaaggagccgtgacatcacctggctgctccagccgcccagccctgccttaggggagcagtgagactccccacaccagaggaagggcccccagcccctgctgccagtgtgtgtccaggacttgggtgcgtctagaaacatatcagcaggcattggtgttctccctgggcaagcaggaagggtgcaggaggaatgagacacacccatcattccttagcccctcctaggacccagcaccctgcaggggctggagatggggacttgtcatcccagtccctgctttaaggagcccacaggctcatctacagccttgctccttagtccctggacaaatgcagcagctgccaagggtctgcgtaacccccaccaacccagtggcccacccctccccatacctctctctatacagactcagtattcaaaccagtcccgcccctccccaactccatcaccccacccacccccaggctgcatcaaatccagctgcccccagttccccaaacatgcccagcccagttcactggctgctcaaccgctgccctcactggtcaatctccccttcttcactggctgtcactgcccatcctttaagacgactcagtttctccaacagcccctcctctgagaagccttccctgatacacacacacaccgtttcacacaggctgggtggggtgccctcctctgggcttcctgcggcctccccttttacagtgcatatcacatcctatcatcctctgcatatgaagctgtcacctctgggagggcacagcccatggttcacatgcctcaggggcgccaagcccagggcctgggacagagcaggactgggtgtgtaaaaaagggtgagagttggactagtgagccaggcacatccagagctgtgagcagctatgcagactcactcctctgacacccagagcagaccagtcctgagccacactcctggctttcaagatggtgcatctataataagcagagcccaggcctgggagacaggaggcttgagttctggccccagccctgtactagcttgctgtgtgaccctcagcaatccctgccccactctgggactcagttttcctgcccacacaggctgactatggctaatcaatttaataactgactctctggggagaaaacaaaagctctgattttagcttctgtccatttccatggtgtgagtcctccatggccaacttcaacttggcatcactgaatgtggagttggaaagaagtgtatgcagtcggctctccctggcgggtgtgagccagctccagcacacctctgttcccatcccctcccaacaccccggactcccacagactgtagggacatggacactcttggtccaagcctggcccaggcatcccgtacttcctgcttctaccttaggggttcctgatgctgagccaggcagagtatggatgaaacggaccacccactgtttgggagacggaagcttcggaggggggtcccctcagcaccacatctgggatctggggagggcaccaccctctgccccctcccagtgcctcctccgcacaccatgccttggggggtgggcacccttccctggggaggggaagcccagagctggacagtcactagcaggtggatagtgccctgggaggcctaatggaggacaaggagccctgaggcagccactaagacggagggagtgggccgggcttttcccctcctggaagaaatgggcggtccccgtgaagctcttgacaggagcccggcctcgcctaagccctagccaccagttgccatcacggtctccgccgagccgggatcctcagccgcttcccgcgcaggcctgctgttcccaatccggccacaagggggcagccccgcgcgcagcctctctgcctgcagccctgagccccggggaaggcgaggccgctccgggccggagcttccagcgcctgctcgcccatttatgggaggcgggcgctatccccactttacagccggggctcgacgaatcaaggccacacaggcagtgggagcaaaggcaaagcccggcaggtgtggggctgggtccctaggggtggaggacggcgggcgggcgccctgctcgtgctgcgagtgcccagccccagcccgcaggcgtcgcctcgccttgcccgccctgctcatgccgggccttccccacccgactgcgcccagcctccttcacccggtcccctcccgctttaccaatccctgccccacgcagctcctcagagccccagggctcttgcagccctaaggggctggactgtgttgcccgcccgcactatgggatgcccgggcgggctcgcacctcccttcttatctgtgctgccctccgtgcccagcattgcgcctggggtgcagggaactcacctggagggagggagggagggaatgaatgaatgaatgaatgatggggagcctgtggaccagcagccaggggacgcgccggctcctctttgcagggactccgagacgcgccttaattcatctcccagaactgtcggcccagctgggaagccaggcagggagggggacgggccccccgcaggctcgcggcagagacgggaaaggcgcaggtgccggactcgcagacagcttggcgcccgccacccgctatccatccagggaggggcctgggccgggagagggcgcctgaggagacagggccccgccgtgaccacaggcccctcgcgtctccgcaggacttcatctgcgtgtcgtacctggagcccgagcagcaggcgcggacgctggcgtcgcgggcggacacccaggcccaggcgctgtgcgcgcagtgcgcggagaagttcgcggtggagcggccgc

SEQ ID NO: 174096 - DNA, 517 bp, Homo sapiens
  Payload ID: 14176
  Gene Symbol: RIN3
  Gene Name: Ras and Rab interactor 3
  ENST ID: ENST00000557762
  CDS Start-End: 130-366
cgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggcccggaaattctggatgctggtttctttctctcgaaagcgacctctgcaaagacaaataccatccggtgggaagaactgggaatccgttggggaagagccccccaaccctcacacccacttgcaagtatctgccacacccaagatggcagggtgaagccggagaggagtttctcagggaggaaggggaggtgaggggccagggcgctggcctcaccggcttctcattttccccagagatgacctagtgtgatccacttcctcttgtctttttttgttcattactgggtcggttatttaaactctctgtatctcagttcacttatcaataaaatgataaataata

SEQ ID NO: 174097 - DNA, 3617 bp, Homo sapiens
  Payload ID: 14176
  Gene Symbol: RIN3
  Gene Name: Ras and Rab interactor 3
  ENST ID: ENST00000620541
  CDS Start-End: 141-2882
gagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttg

SEQ ID NO: 174098 - DNA, 1846 bp, Homo sapiens
  Payload ID: 14177
  Gene Symbol: RINL
  Gene Name: Ras and Rab interactor like
  ENST ID: ENST00000635328
  CDS Start-End: 366-1724
aggccaggtcatgactcactggcttcctgcaacctgacgatggcccagccagaagacaaggcacctgaagtccccacagagggggtgaggtgaacaaagcagacaggacccctctaggggtcctcagcaccctagagccacttactcgcctgcagaggacatggggggtgtggcatgtgccagagctggatacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgcatgccagacctgccccatctcctggcctttctatcagccagcagggatgttctgcccagaaccctgctcttgccccctcccactctagggcccagagatgaacacacagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagccccgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctacc

SEQ ID NO: 174099 - DNA, 1910 bp, Homo sapiens
  Payload ID: 14177
  Gene Symbol: RINL
  Gene Name: Ras and Rab interactor like
  ENST ID: ENST00000635542
  CDS Start-End: 88-1788
cttcctctctccacttcctgctactgcaggcctctcctccgagaacagaggccaggtcatgactcactggcttcctgcaacctgacgatggcccagccagaagacaaggcacctgaagtccccacagagggggtgaggctggtcccaccacaggtgaacaaagcagacaggacccctctaggggtcctcagcaccctagagccacttactcgcctgcagaggacatggggggtgtggcatgtgccagagctggatacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgcatgccagacctgccccatctcctggcctttctatcagccagcagggatgttctgcccagaaccctgctcttgccccctcccactctagggcccagagatgaacacacagatcctgtgcagatcggcagggtccaacaggacaccccagggaaggtgctttccattgtgaaccagctctacctggagacccacagaggctgggggagggagcagacccctcaagaaacagagccagaggctgctcagagacatgatccagcccccaggaaccctgcgcctcacggggtctcctgggtgaaaggcccgctcagcccggaagtggaccatcctgggccggctctcgccagcctactggaagaggaggaggaagaccttgaaggaaaggaggaaggaagggaggacgaccctgaagaggaaggccctgaggacgtgctcaccattcacgtccagtctctggtcagggcccggagcagctacgtggccaggcagtaccgaagccttcgggtgcgcatcgcctcagattctgggggtccccacgggtctggggacccggccacggagctgcttcaggatgtgcggcacctccttactgacctccaggatcacctggcaaaggactcctacatcagggctgtctttggaagcaggggtcctgggctccccaagaaggacgaggatccaggccccgcgctggagacggcggtgtgccaggcggtgctggcgcccctgaagccggccctgtggacacgactccgcacactccgagcaccggagctgcggcggctgcggcggcgacagacagccctgcgggcgggggcggggcctccgggggcacaggggccgggaccggaagggcagagccccgcccccgccttgcggagccgcatccacgagcgccttgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctacc

SEQ ID NO: 174100 - DNA, 346 bp, Homo sapiens
  Payload ID: 14177
  Gene Symbol: RINL
  Gene Name: Ras and Rab interactor like
  ENST ID: ENST00000634563
  CDS Start-End: 183-346
agcgtggtggggagagccttgagagttggagccaggcgggagagggtagcactggtgggaggaatctatgcggtcctgaagattctgatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcag

SEQ ID NO: 174101 - DNA, 1810 bp, Homo sapiens
  Payload ID: 14177
  Gene Symbol: RINL
  Gene Name: Ras and Rab interactor like
  ENST ID: ENST00000634655
  CDS Start-End: 1-520
tgcgcacctccacgctgcctgcgccccgcgccgcaaggtggcgctcctcttggaggtgtgcagagatgtctatgcgggcctggctcgaggcgagaaccaagatcccctgggggccgacgccttcctgccggcgctgaccgaggaactcatctggagcccggacattggggacacgcagctggacgtagagtttcttatggagctcttagatccagatgagctgcggggagaggctgggtactacctgaccacgtggtttggggcgctgcaccacattgcccactaccagcccgaaacagaccgcgctccccgggggctcagctccgaggcccgcgcctccctgcaccagtggcaccgcaggcggacgctgcacagaaaggatcatcccagagcccaggtgactgcccatctggctgcaagtagaagggagggtgagacctggtgcccttctgacccagctcccacctctccccacaggccaacctgccctttaaggagccatgggcagaagagactgtgacagggaccagtgacaactaggggtttcacacccctccgttcatgcctgtaatcccaacattttgggaggccaaggtgggaggattgcttgagcccaggagtttgagaccagcctgggcaaaacagtgggacccccatctaccaaaaaaaaaaaaaaacaaaaattagccgggcgtggtggcgtactcctgtggtaccagctactcaggaggctttgcagttttagacaggcgtatcagagaaagcctcactgaggtgacatctgcagaaaggcctgaaggaggggaggggaagggaggagcagagtgggtattaggaagagcattccgagaagcaggatgagccagtgcaaaggcccagaggtaggctgttcccttttcctgggacccctccctcctccttgctgctcctaaaccacataggtcaggagtctggactgacccaggtacgtctggcatcttgcttgaggaacagggggttttgttttgttttgaaagaacgtctctgtctgttgcccaggctggagtgtagtggcatgatctcggctcactgcagccttaacctcctggctcaaacaagccccctgcctctgcctaccaagtagctgagactacaggcacctaccaccgtgcctgtctaatttttaaaattttttataaagatgaggtctctctttgttgcccaggctggtctcaaactcctaacctcaagcaatctgcccacgtcggcctcccaaagtgctgagattataggcgtgagccaccgtgcccaattgtgatcgtttttcccaaagaatgtatcacatgctaacaaaccatatatttatgtatttcattgttcatagtaactacaatttaaaaaactaaaaagaaacaagtgaggccgggtgcggttgctcatgcctgtaatcccagcactttgggaggccaaggtgggcagatcacctgaggtcgggagttcaagaccagcctgacaaacatggagaaacccgtctctactaaaaatacaaacttagccgggcatggtggcgcatgcctgtaatcccagctactccggaggctaaggcaggagaatggcttgaacccgggaggcgaagattgcggtgagcggagattgcgccattgcactccagcctgggcaacaagagtgaaacaccatctcaaaaataaataaataaataaaaagaaacaagtgaagttaacgttaataataatatatttgatttaacacaatgtatcccaaatattatcacttcaacatgtatccatattaaaaagttactgacatattt

SEQ ID NO: 174102 - DNA, 1910 bp, Homo sapiens; identical to SEQ ID NO: 174099
  Payload ID: 14178
  Gene Symbol: RINL
  Gene Name: Ras and Rab interactor-like
  Uniprot ID: Q6ZS11
  ENST ID: ENST00000591812
  CDS Start-End: 88-1788

SEQ ID NO: 174103 - DNA, 1810 bp, Homo sapiens; identical to SEQ ID NO: 174101
  Payload ID: 14178
  Gene Symbol: RINL
  Gene Name: Ras and Rab interactor-like
  ENST ID: ENST00000593424
  CDS Start-End: 1-520

SEQ ID NO: 174104 - DNA, 1846 bp, Homo sapiens; identical to SEQ ID NO: 174098
  Payload ID: 14178
  Gene Symbol: RINL
  Gene Name: Ras and Rab interactor-like
  Uniprot ID: Q6ZS11
  ENST ID: ENST00000598904
  CDS Start-End: 366-1724

SEQ ID NO: 174105 - DNA, 346 bp, Homo sapiens; identical to SEQ ID NO: 174100
  Payload ID: 14178
  Gene Symbol: RINL
  Gene Name: Ras and Rab interactor-like
  ENST ID: ENST00000593809
  CDS Start-End: 183-346

SEQ ID NO: 174106 - DNA, 2768 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000308091
  CDS Start-End: 226-2160
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatacagccaaggtcagaagtcatgcatcctgtcaccattcaaacagcttttgcagccggacatttttcctagattgttagatggtctagctattttactgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctctgta

SEQ ID NO: 174107 - DNA, 9808 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000319170
  CDS Start-End: 301-4053
caaccccgccttctgcgtctcggctggacgcgagcacactcggctccgccgccgccgccgccgccgcggggcgctgcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccaccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtagccaccataggactttattttcatgatatctgtaatcactgctacaatcagctcacctgatcatctgtgaattcaggtgttcagagcctcctggtatgatgttattcaggtagtgtccagctatatgtgtatgtgtgtgtgtacacgtgcatgtacacacagctgtacagtgtgtgtatatatgtatacatatatgtatgtgtatgtgtatatagagagagagctgagagttattctatttattccttttctctcctaatctgaaaatgggtgttctgtattttgggtggaagaggcatagaaggggatgtgtgttgtctcttaagatttctatatcatgtggattggaccaaaaacttctaatcacttatttagaaggtatttataagtgtctgtccatgtgtagcctattcgtgcatgttgtgtattatataactaaggaatagatgtagaatgtgctatttctggttgagaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcagaaatcagttgacattgtcccacaaggaaaaagtgatgccagtaaagtgggggaagagatggtaaataattctagaatgagcaaaagtgcttaattagtacagtatactcaaggtcttgcataacccacactccacgaaaaccgcatcgtaaacagagagtgaacagcacctctccattgctacatctccagaatattgttcggttatgttcatgtggttatggagcaataagaatatataccattaatttttaggtctttcaaattgttcaccaagttttgtgtttgatatttatgaagtgatctttaacacatctgcattgttaatttaagcatgcacagaaatttgggtaatgtttgagtagattgccaagcgctactgtgattcatgaatgaatttctcatagtcttctgcctgcagttttatagtttgaggggcacccatatttgtgggttagagttagtaagaatatgaatccagttatcaaagtattcatccctgaggttttgagttttattgtggtggtgattttctcatgagaaggtagacaacacttcagtttttcttgagggggaaaaaatgtacccgctaaccttttttcacccatgatttgagccctaaaacaacagcctttatgttttcagtgcaggatttcttggaatttcttgcttgtatcaatcctgatgatagccatcctgaacagatgcttctggtctgttttcctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccctctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcctaatttctactatggataatttcaaagtagaatcactctatgcttagagttttggcaccaatgctgtagggcagcagaatctattctcagtaaaataacttatggtttattagatattctgtattggattttaccagcttgacttttactgctcagatgctttctttcccccccttagacgctgtaattctcttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaagttttatttgctgctattctgggagaataaacttgtatatggagaataaactaataaacttgtatcgaggaaatccataaagttataaattagcctgaaaaatatttcaggtaatggtgtggattggcctgctttgactctcagccaccaacagaaatctttgtcacctttgttcctcagctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagagggtgactgtttctaggggaagaaaaccctttagattgcaggtaactttcacttttttttttttaatatacactttacatttgtataaattatgcagggtactcctaaccctgtagaaatgtatgacctctcacaaagttgagatttgatccaaagagaaatgcaagtataaaagaattagatacttattatcttttaaggtttttttttttttttggtagagatgggggtctcactgtgttgcccaggctggtctcaaactcctggccacaagtgatcttcctgcctcagcctcccaaaatgctgagattacaggcatgagccactgtacccagcctttccttataaaattcaaagagaaaatttctacacctttatccctcaaataaaacaagtgctcagttcttaccgtgcccttgcaaggtctatatgtaaaagaaatctgaaatttagctgtagaataaaacttgataaataaaaagaaaaaacatacatttctccagttggtttgctctttgcttgttgaagtaataaaccgttttaaagagaaaatacttgctgtaaacccccagtgccttcaactcttttggcagaatatttttaaagaaatccagcaagcaaactttgaggtgctaatgaaagtaaaggaaggtggtatttctagttttggcagaaatgaaaagtgtctcacaagagacatcactacccacgtggggtctggctgctttctaccaaagacatttagagaagtgaattgagtcagggtgatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaacatggggactttgagtgtttgtggatcggcaccattaagaatctggttttgcatttcatgtcagggtacccaaaacataggccatacacagaagaaattaagtgtggtaaataaactagtttgatatgttcaa

SEQ ID NO: 174108 - DNA, 3909 bp, Homo sapiens
  Payload ID: 14179
  Gene Symbol: RAPH1
  Gene Name: Ras association (RalGDS/AF-6) and pleckstrin homology domains 1
  ENST ID: ENST00000374493
  CDS Start-End: 1-3909
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccaccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtag

SEQ ID NO: 174109 - DNA, 1779 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000419464
  CDS Start-End: 1-1779
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 174110 - DNA, 2673 bp, Homo sapiens
  Payload ID: 14179
  Gene Symbol: RAPH1
  Gene Name: Ras association (RalGDS/AF-6) and pleckstrin homology domains 1
  ENST ID: ENST00000457812
  CDS Start-End: 153-1937
gtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagatcaactgaactcttaaaacttggagagaagtctgcactttgagatgtctgttctttatcaacttcctgactgctcaaagttgaatcagaacatgaggagagagaggtgaaatcagatgaggtttgggagaatagagtgaggaaaagaacttagtgcttggaaaatgagagatttacctgaagtaatctgaacagattatggtactatgaccatcacattttgcactgaggtagagaaaatacctgtaagttcgatttctttgattcacagaagctgtcctcacagggctctgctgcgagggagccatattacgggttgggctaggtacgtaatcatttggtaccactggaggacgcactggctccagtgtgcgatagggggagtgccgcctacaaaaagaagagcgtatgtattgtatgattaagcaagtttcggcacaataaattcaaagagttgccagcagttgagatacaatttgtaatcagagataggaaatgtgttttaacataacccagctaccaatttcagtctttactaatgtatcacttctccaccattagggttttggtgaatattgttatttttcagtctccaacctcatttccctgtgctaatgcaattttgttcatttattctcaaagagcacaaaggttctctaccatttaagccaatgtttcccagaccctacctcttcttagaagagttggaattcttttagtatcatattaaagtctcccaactgta

SEQ ID NO: 174111 - DNA, 1794 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000418114
  CDS Start-End: 1-1794
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaa

SEQ ID NO: 174112 - DNA, 1860 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000423104
  CDS Start-End: 1-1860
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctgaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 174113 - DNA, 2394 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000453034
  CDS Start-End: 226-2175
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggtaacagcttcgttttaatttacattgaaaattctgtggtattcttttgggtttaaattgttgctctcttatgtctttatcggggatcttatttggccttatttcagtctcctttattaattttcaatcttcctaattgtagtgggtaaagacagttcagagagacctgttgatttgacttccccttggaaatgagtattttacaaattggctctaatgacttaaaatctcaaaaaa

SEQ ID NO: 174114 - DNA, 1854 bp, Homo sapiens
  Payload ID: 14179
  Gene Symbol: RAPH1
  Gene Name: Ras association (RalGDS/AF-6) and pleckstrin homology domains 1
  Uniprot ID: Q70E73
  ENST ID: ENST00000439222
  CDS Start-End: 1-1854
atggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaagtaa

SEQ ID NO: 174115 - DNA, 492 bp, Homo sapiens
  Payload ID: 14179
  Gene Symbol: RAPH1
  Gene Name: Ras association (RalGDS/AF-6) and pleckstrin homology domains 1
  ENST ID: ENST00000420371
  CDS Start-End: 226-492
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgctctgaatcagggagagactgtggatctggatgccttgatg

SEQ ID NO: 174116 - DNA, 585 bp, Homo sapiens
  Payload ID: 14179
  Gene Symbol: RAPH1
  Gene Name: Ras association (RalGDS/AF-6) and pleckstrin homology domains 1
  ENST ID: ENST00000428637
  CDS Start-End: 70-585
aaagattgtctccgttattttgctttttgtgtggtgaatttcccagaaaccagatgcagccctactcaaatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcag

SEQ ID NO: 174117 - DNA, 4134 bp, Homo sapiens
  Payload ID: 14179
  Gene Symbol: RAPH1
  Gene Name: Ras association (RalGDS/AF-6) and pleckstrin homology domains 1
  ENST ID: ENST00000630330
  CDS Start-End: 226-4134
gcggccgccccgcccccgctcccgccgccgcccgccagtcagtcagtcagtcagtcagtcagtcagtcagtcagtcactgagcgcgcggcgcgggagctgctggcagtcgctgcgtctctggcgagggagcgccgcgcctggggaggaggcggaggcagcggctggaggagcgcgagcggcggtttccttgcccggggccgcgggaaggccgaccgactgccgcgatggagcagctatcagatgaagaaattgatcatggtgctgaagaagacagtgacaaggaagatcaggacctggacaaaatgtttggagcctggcttggagaactagacaaactcactcagagtttggattctgacaagcccatggaaccagtaaaaagatctcctcttcgccaggaaacaaacatggccaacttttcttaccgcttctccatatacaacttgaatgaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgagcatgctatttctctgagatgttccagcaagcaggccaagcgtcatattgacttcacagaagaacaggctgagctgacacctcactcctatctggacagggaaacctcccttcttctgagaaacattgcaggaaaaccttctcatttgctgaccaaggaagaacaggcagcaaaattgaaagctgagaagatcagagttgccctagagaaaattaaagaggcacaagtgaaaaagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatggagagaatctttgaagaccatgaaaacttggttgaaaatcttcttaattggacaagagatagccaaaacaagcttatatttatggagcgtatagaaaaatatgcacttttcaaaaacccacagaattatcttttggggaaaaaagaaacagctgagatggcagatagaaacaaagaagtcctcttggaggaatgtttttgtggaagttctgtaactgtaccagaaattgaaggagtcctttggttgaaggatgatggcaagaagtcctggaaaaagcgttattttctcttgcgagcatctggtatctactatgttcccaaaggaaaagcaaaggtctctcgggatctggtgtgctttctccagctggatcatgtcaacgtttattatggccaggactatcggaacaaatacaaagcacctacagactattgtctggtgctgaagcatccacaaatccagaagaaatctcaatatatcaaatacctttgttgtgatgatgtgaggacactgcatcagtgggtcaatgggatccgcattgcaaagtatgggaagcagctctatatgaactaccaagaagccttgaagaggacagagtcagcctatgattggacttccttatccagctccagcattaaatcgggatccagttcttccagcatcccagagtctcagtcaaaccactccaatcagtctgatagcggagtttctgacacccagccagcaggacacgtccgttcccagagcattgtgagctccgtattctctgaagcctggaaacgaggcactcagttggaagagtccagcaaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagctcccccaaaaccccttgtgaccatccccgcaccaaccagcaccaagactgtggcacctgttgtgactcaagctgcaccacccacacctactcctccagtgcccccagcaaaaaagcagccagctttccctgcttcttacattccaccctctccccctacccctcctgttccagtacccccgccaacattacccaagcaacagagcttctgtgcaaaaccccctccctctccactgtcaccggtgccctcggtcgtgaagcagatagccagccagtttccaccccctccaactccccctgccatggaatctcagcccttaaagcctgtcccagcaaatgtagctccacagtcccctcctgcagtaaaagcaaagcccaagtggcagcccagctccatcccagtcccttctccggacttccctcctccccctcctgaaagcagcctggtgtttcctcctccacccccatcacctgtcccagccccaccaccaccacctccacccacagcttctcctacccctgacaaaagtggatctccaggcaaaaagaccagtaagacgtccagccctgggggaaagaaaccacccccaaccccacagcgcaactccagcattaaatccagcagtggtgcagagcaccccgagcccaagagaccctcggtggacagtctagtcagcaagtttacaccgccagcagaatcagggtctcccagcaaggagaccctaccacctcctgcagcaccccccaagcctggaaaactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtag

SEQ ID NO: 174118 - DNA, 2530 bp, Homo sapiens
  Payload ID: 14180
  Gene Symbol: RASSF10
  Gene Name: Ras association (RalGDS/AF-6) domain family (N-terminal) member 10
  Uniprot ID: A6NK89
  ENST ID: ENST00000529419
  CDS Start-End: 1-1524
atggatccttcggaaaagaagatatcggtgtggatctgccaggaagagaagctggtgtccggcctctcccgccgcaccacttgctccgacgttgtgcgagtgcttttggaggacggctgccggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggccatgacccaggagaaacagcggcgagtggtgcgcaaggcctttcgcaaactggccaagctcaaccggcggcgccagcagcagacaccgtcgtcctgttcgtccacttcgtcgtccactgcctcgtcctgctcttcgtcgccgcggacccacgagagcgcgtcggtggagcgcatggagacgctggtgcatctggtgctttcccaggaccacacaattcgccagcaggtgcagcggctccacgagctggaccgcgagatcgatcactacgaggccaaggtgcacctggaccgcatgcggcgtcacggggtcaactacgtgcaggacacttacttggttggggcaggcatcgagctcgacgggtccagaccgggagaggagccagaagaggtggcggcggaggcggaggaggcggcggcggcgccccctctagccggcgaggcgcaggcggcggcgctggaggagctggcccggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtaccagcctttacattgggctgcggctcaacacggacctagaggccgtcaagtcggacttggattacagccagcagcaatgggacagcaagaagcgcgagctacagggccttctgcaaactttgcacactttggagctgacggtggcaccggatggggctcctggctctggcagtccctcgcgggaacctgggcctcaagcctgcgccgacatgtgggtggaccaggcccgtggactggccaagagcggtcctggcaacgacgaagactcggatacgggactgagctctatgcatagccaagactcggactccttgcccatgtgcgaatcccttgtgtaggggtggggggcggggggcggggggcgggaacagggggattcttttttcttgcagaatgcagtgggccagccggctcgcggacttgaaaccaggctgttgcgagcccagagctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacctctttgataaaacccataggcaccaaaatcctggctgtttacatttctgcagatttgggaattacccatctgctaaatcatttgtcttttattttctttcaaaggctaaactgtatcgaagtctaaccctgtatttcctcctagtaaacacaatagatgttaaaagggaattcttttcccaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcactctttgaaagcaaagatgttttagtgttcagcttttaaattgagctatgtgattaaaaccaaccatgaccttaacg

SEQ ID NO: 174119 - DNA, 1731 bp, Homo sapiens
  Payload ID: 14181
  Gene Symbol: RASSF7
  Gene Name: Ras association (RalGDS/AF-6) domain family (N-terminal) member 7
  Uniprot ID: Q02833
  ENST ID: ENST00000397582
  CDS Start-End: 86-1099
ggcccgggtgcgccgcggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcc

SEQ ID NO: 174120 - DNA, 1928 bp, Homo sapiens
  Payload ID: 14181
  Gene Symbol: RASSF7
  Gene Name: Ras association (RalGDS/AF-6) domain family (N-terminal) member 7
  Uniprot ID: Q02833
  ENST ID: ENST00000397583
  CDS Start-End: 434-1555
ccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgttcccatgccggcggccgcggggcctggcgtgcgggcgcctccgcgccgcccggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagc

SEQ ID NO: 174121 - DNA, 1745 bp, Homo sapiens
  Payload ID: 14181
  Gene Symbol: RASSF7
  Gene Name: Ras association (RalGDS/AF-6) domain family (N-terminal) member 7
  Uniprot ID: Q02833
  ENST ID: ENST00000431809
  CDS Start-End: 119-1132
tcccgcaccaggactctgcgcccgccagctccgcagggctccacctccctcgccgggactggtgaccctgcgaccccgcgacccctgcgcgtccagactactgcagctgcggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtg

SEQ ID NO: 174122 - DNA, 1450 bp, Homo sapiens
  Payload ID: 14181
  Gene Symbol: RASSF7
  Gene Name: Ras association (RalGDS/AF-6) domain family (N-terminal) member 7
  Uniprot ID: Q02833
  ENST ID: ENST00000454668
  CDS Start-End: 36-998
ggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagc

SEQ ID NO: 174123 - DNA, 1679 bp, Homo sapiens
  Payload ID: 14181
  Gene Symbol: RASSF7
  Gene Name: Ras association (RalGDS/AF-6) domain family (N-terminal) member 7
  ENST ID: ENST00000414138
  CDS Start-End: 71-433
cggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaatagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttccc

SEQ ID NO: 174124 - DNA, 473 bp, Homo sapiens
  Payload ID: 14181
  Gene Symbol: RASSF7
  Gene Name: Ras association (RalGDS/AF-6) domain family (N-terminal) member 7
  ENST ID: ENST00000528736
  CDS Start-End: 223-473
aggaagctggtgaagtgggggaggatgcgtgctccggagggccgccaccccaggaatgtgtggctggcgggtggggctggcacaggagggtggggcccgtgcggaggggcggcagcccagccgtttctagggcaggccaagaggatgaggagaggaggaccagcctgcgataggagtaggcaggtcctgacccggtgcctgcgccctccccacaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcct

SEQ ID NO: 174125 - DNA, 810 bp, Homo sapiens
  Payload ID: 14181
  Gene Symbol: RASSF7
  Gene Name: Ras association (RalGDS/AF-6) domain family (N-terminal) member 7
  ENST ID: ENST00000531112
  CDS Start-End: 1-584
ctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccac

SEQ ID NO: 174126 - DNA, 1731 bp, Homo sapiens
  Payload ID: 14181
  Gene Symbol: RASSF7
  Gene Name: Ras association (RalGDS/AF-6) domain family (N-terminal) member 7
  ENST ID: ENST00000620201
  CDS Start-End: 86-1099
ggcccgggtgcgccgcggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacaggggccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcc

SEQ ID NO: 174127 - DNA, 1450 bp, Homo sapiens
  Payload ID: 14181
  Gene Symbol: RASSF7
  Gene Name: Ras association (RalGDS/AF-6) domain family (N-terminal) member 7
  Uniprot ID: Q02833
  ENST ID: ENST00000622905
  CDS Start-End: 36-998
ggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacaggggccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagc

SEQ ID NO: 174128 - DNA, 1928 bp, Homo sapiens
  Payload ID: 14181
  Gene Symbol: RASSF7
  Gene Name: Ras association (RalGDS/AF-6) domain family (N-terminal) member 7
  ENST ID: ENST00000622100
  CDS Start-End: 434-1555
ccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgttcccatgccggcggccgcggggcctggcgtgcgggcgcctccgcgccgcccggggagggggcagtgtcctccgagccaggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacaggggccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcagggccctctgcctccagccagagaggagtccctcctgggcgctccctctgagtcccatgctggtgcccagcctaggccccgaggtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagc

SEQ ID NO: 174129 - DNA, 1745 bp, Homo sapiens
  Payload ID: 14181
  Gene Symbol: RASSF7
  Gene Name: Ras association (RalGDS/AF-6) domain family (N-terminal) member 7
  ENST ID: ENST00000631421
  CDS Start-End: 119-1132
tcccgcaccaggactctgcgcccgccagctccgcagggctccacctccctcgccgggactggtgaccctgcgaccccgcgacccctgcgcgtccagactactgcagctgcggacaggcatgttgttgggactggcggccatggagctgaaggtgtgggtggatggcatccagcgtgtggtctgtggggtctcagagcagaccacctgccaggaagtggtcatcgcactagcccaagcaataggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacaggggccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtg

SEQ ID NO: 174130 - DNA, 473 bp, Homo sapiens; identical to SEQ ID NO: 174124
  Payload ID: 14181
  Gene Symbol: RASSF7
  Gene Name: Ras association (RalGDS/AF-6) domain family (N-terminal) member 7
  ENST ID: ENST00000633903
  CDS Start-End: 223-473

SEQ ID NO: 174131 - DNA, 810 bp, Homo sapiens; identical to SEQ ID NO: 174125
  Payload ID: 14181
  Gene Symbol: RASSF7
  Gene Name: Ras association (RalGDS/AF-6) domain family (N-terminal) member 7
  ENST ID: ENST00000632833
  CDS Start-End: 1-584

SEQ ID NO: 174132 - DNA, 1679 bp, Homo sapiens
  Payload ID: 14181
  Gene Symbol: RASSF7
  Gene Name: Ras association (RalGDS/AF-6) domain family (N-terminal) member 7
  ENST ID: ENST00000632673
  CDS Start-End: 71-433
cggcgctgggggcggcaggttgcggcggcgccggagcgggtctccaggctggcgagcgcccaggacaggcatgttgttgggactggcggccatggagctgaaggtgtgggtggatggcatccagcgtgtggtctgtggggtctcagagcagaccacctgccaggaagtggtcatcgcactagcccaagcaatagactggccgctttgtgcttgtgcagcggcttcgggagaaggagcggcagttgctgccacaagagtgtccagtgggcgcccaggccacctgcggacagtttgccagcgatgtccagtttgtcctgaggcgcacaggggccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttccc

SEQ ID NO: 174133 - DNA, 1994 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000282884
  CDS Start-End: 542-1801
agtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacac

SEQ ID NO: 174134 - DNA, 2320 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000381352
  CDS Start-End: 323-1501
ggggagtgcggcgcggggacgggcgctgggcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggggatcatcattctttctgataagcaggagtgtaaagattagatatcacaccaaaagctcaggcaagaaaagcaaaaatgaacaagtgggactacattaaacccaaaactcctgcacaacaaaggaaacgatcaccaaaatgaaaaggtggactgtagattgggagaaaatatttgcaaaccgttatctggtaagggtttaatatccaaactatataaggaactcacagaacttaaagaaaacaaataatccaattaaaaatggtcaaaggggctgggcatggtggctcacgcctgtaatctcagcactttgggaggccgaggtgggagaatcacaaggtcaggagactgagaccatcctggctaacaccatgatgggctaacacccatctctactaaaaatatgaaacattagccaggtgtggtggcacgcgcctgtaatcccagctactcgggaggctgaggcagaaggattgtttgaacccgggaggtggaggttgcagtgagccgagatcgcattactgcactccagcctgggtaacagagtgagactccatctcaaaaaaaaaaaaaatagatatttttccaaagaagacataaaaacagccaacaggtatatgaaaaagtgctcaacatcactgatcagcagggaaatgcaaatcaaagccacaatgagataccacctcacacctgttaggttacatctgctattgtcaaaaagataagagatagcaagtgtcagcaagggtctggagaaaagggaatttttgtatactgttggtgggaatgtaaatcagtacagctattgtggaaaacagtgtagaggtttctcaaaaaattaaaactatcatacaacccagca

SEQ ID NO: 174135 - DNA, 5510 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000405154
  CDS Start-End: 200-1459
gcggccgcggagctccgggtgccgccgcgtccccagcgccccggccggcccctctgggcggcctgcgggggcggcgcagttgcgaaactgactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgttgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgttttttttaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggca

SEQ ID NO: 174136 - DNA, 2219 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000542865
  CDS Start-End: 293-1552
atgtgaggacacagcaagaaggtgccatccgtgaaccaaaaagtgagcccttgccagacacctgatccgctggtgccataatcatgaacttcccagtctccagaactgtgagaaatacaagtttctgttattggtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggcca

SEQ ID NO: 174137 - DNA, 555 bp, Homo sapiens
  Payload ID: 14182
  Gene Symbol: RASSF8
  Gene Name: Ras association (RalGDS/AF-6) domain family (N-terminal) member 8
  ENST ID: ENST00000542315
  CDS Start-End: 188-555
aaaccatatttcactgggagagcaaactgctagcatttatcatcccctccagctttaagttacagaggctaaactcctgctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggag

SEQ ID NO: 174138 - DNA, 523 bp, Homo sapiens
  Payload ID: 14182
  Gene Symbol: RASSF8
  Gene Name: Ras association (RalGDS/AF-6) domain family (N-terminal) member 8
  ENST ID: ENST00000535907
  CDS Start-End: 251-523
gcggccgcggagctccgggtgccgccgcgtccccagcgccccggccggcccctctgggcggcctgcgggggcggcgcagttgcgaaactgagtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagac

SEQ ID NO: 174139 - DNA, 789 bp, Homo sapiens
  Payload ID: 14182
  Gene Symbol: RASSF8
  Gene Name: Ras association (RalGDS/AF-6) domain family (N-terminal) member 8
  ENST ID: ENST00000539545
  CDS Start-End: 1-627
aagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctggacttttttataatatgagacttcagttggtattaataggagttacctatttaatt

SEQ ID NO: 174140 - DNA, 853 bp, Homo sapiens
  Payload ID: 14182
  Gene Symbol: RASSF8
  Gene Name: Ras association (RalGDS/AF-6) domain family (N-terminal) member 8
  ENST ID: ENST00000542004
  CDS Start-End: 195-853
tcactatcagcgaaccagaaagcaggctctcacccgacgctgagtctgacggtgacttgaccttggactttccagcttccagaaaactgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaat

SEQ ID NO: 174141 - DNA, 5505 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000541490
  CDS Start-End: 193-1452
ccaggactgtaagaaccctatgtacctttgcaggtgcctgtgtagatcatcctagaatacctgtgtggtgctgtccttcctcaagactacctcattctcactggctcggagactcctgcctgctgagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggaggcaccattccagtctgggtccctgaagcgacctggttcatctcggcagctccccagtaatctccgcattctgcagaatcctatctcatctggttttaatcctgaaggcatatatgtatgacattatctgtctttagggaggagacccaacagaggtaccaaggacagtaaacttcctttttgatttgtgccaatgatgaacagaggatctattccacaagacgctgtatgttttttctctcctaaattgcataccacttggagccataccctgtgcactgatgctaaagaacaaagaaactgtgttttcacacatcaacagtgttgatatttttgtccagcagctataatgcaaagccttcgtttttatttgtagcattttgagagctttaggaaagtattatatagtgtgtatacataaataagccgtgacttaagtaagagtgaagagaaatttgtgactggcttagtttaatttatttcatgtaatcaatgtgtgaatgttgatgttttaatatttttattgacttatcctgtgactgacttacgttacatattgtgtgattatgaccgtgtgcatgttgccagactccatccatgcattgctgatttacactacacaagtgtcctagggtgctccaccatcgaagctaactccacaggaagccacttgcatttgttttgtgaaactgtcctagccattgcttaattaggtgaaataattcagggttttttaaatctggaatttagtcgttcctttacaatatttccaaatatacgtgtggccacagagcataacagatatttttcataagctaaattgtatgtataaaacatttgcagtgtttcagacactgttgaacaaaaatgtaattggtaagtatgtatccaaacaggcatggggtttcctgatacattatgtgttttgtttctgccctgtcttatcatttacactcatggatcttcagaattaatctaacatggaagttatagatacctgaaagctgggttggtctacttcaggaacattgctttaagtgatgtattttaaaataacccgcttcatatgtatgatctgttggtgtacacaccatgggtaaggtattgcttgcacataatttgctctgcatattatggaccattgtggtttcttccagtcacttagatggaaaggaggttaaacctaggtactttttagcaaggatataaagtcaaattcagcatatgtttttatttttaggcttgacttttacaagacattaatctccatttgtacatatgttattttatttgtaaaaccaaatatgactcaacacctttttgatgagtagtgacttaactaagatttacaagtaatatttagacagattcagtcagacaccacttagccatttttacattccctctggttagatttggtacagtataattaagactttaatctgaaatttaaagtagttttaattctgaagaagttacatcctctgtattatttacatgcaacaaaataaaagtggattaatatagtaatgccatggtaacaatagagctatgtcttatgcatgaaggcaactttggatgttttaacacatttgactgactttggtttagtgaatgctgacaatgctgctctacttaggtttcctatgaaatttttaagaatggctatgagactgtatagaagcttctagagaactgaaagtcataatgcagagttgccttttctagtgcagctaagtggcggacctcaactgaagatatgagtttctttgggttcttggagttatcaaattgatcttgccattatgttactttgcaaataactgaagtaaatgattcttacctaaataaccacaacctgtacacatttgctcacaatttatagtagttattttctatctacctatatttaaaattaggatgattaaaaaataatttatagattttgtgacagtaatgatttacatatgcccaatatatgccttatttttaaataagtcattctgtataaagtcattttgttgttgttcagagaaatcaagatcttattcacaaagaaaaacattttataaattgatcgcattttctttaagtcaaaatgttaaactggaggcagtattaaactttgcaattaggagtttcagagatgccttggcataccacgaaaaacactgtcaatatccaactcattataaattgttatcagaattaacctaataactttaagtaaggacaagcagcatcctagcaacttgtagtagtcttgggttcccagcagagtatcacagttaacctctctgacaacttcatcagaatttccaagctgccaaataatcttcatagacctaattacagatttaaaaaaatttcctaggcgacgaaagtatagaaatgtgaatatgttgaatacattgagaagctgtactttttaattagttatattacttctggaagcacatatctaaggaatattttctaagactcagagggaaaaaaactcgttttcataggatcatctgaagatactttagtatatttgtgatcatttttatctattgcaaatacaaatgaattagataagtgccacatcctggatacatttcggaggggtagtgggcaatggtatacaaaaataccaaatataaaattttcatctgggggaatgttcaggttctaaatactaaattagatttcaatgttttgtgttttttttaaaaaaatcatattgcaacttgttttattgtgattttctacaagtattaaatacatttaaagatctttttatcttaccaagaaataatttggaatagcattggtatatttgaccttttgagtgtctgtcatcctcagagaatggcccatagtgtgttgcctgtggacatagtgtccatagtccctttcttgtccttctgagatattttggtttgataacattttgttttttgtcttgatgcacagggacttttttataatatgagacttcagttggtattaataggagttacctatttaattctcccagtcatcaatgaggtaatcatcaattcctatagttcaaattagtcataaacaagagctacagcaagactgatagagtaaaaactatataaatacagtaaaaaaaaaatagaatttatggtgtgaaatatgaagtatagcaatatataacaagaacatgtaagcacttgcttccacagcataaatgtaatttacatctgcattaaaggataattttctctgtgaataagagcaaaatggtcttcagagaaacagactgttcatttgaagccatttctgtaaacatcttccaagatagaactgtaatggattgaggaaataacacagaaaagacaaaaacttttgatttcaggcatgcaaagtgcttgggcagatggacagttcccattgtgcattgcctttgataaatttggccttaatttatataacgatgctgtgttcacatccctctcctacctaaagttgtctttattggtttatattgtgttaaaattagcttataattattacttttgtattgtgttcagttttttaagttgcatgtttatactatttgctacagtatttttaagtttggggtgaaggccatcagctgtatcaaaaagacaaaacaatcactatttattcagtattgctgctttacatctccagaataagctttcgatgccaggacagtgactgcctgaaagctgcaggagctcttttcaatgcattttatatatttttagaaaccaaataaatgcagaaaactatttcgtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgtaaaacaaagaatcaatattggatattctcccaaataataaattttcaggattcattggggcatt

SEQ ID NO: 174142 - DNA, 577 bp, Homo sapiens
  Payload ID: 14182
  Gene Symbol: RASSF8
  Gene Name: Ras association (RalGDS/AF-6) domain family (N-terminal) member 8
  ENST ID: ENST00000545413
  CDS Start-End: 100-577
gaacgatgaccaatccaccacacgcacctacagtctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgca

SEQ ID NO: 174143 - DNA, 587 bp, Homo sapiens
  Payload ID: 14182
  Gene Symbol: RASSF8
  Gene Name: Ras association (RalGDS/AF-6) domain family (N-terminal) member 8
  ENST ID: ENST00000537946
  CDS Start-End: 499-587
agtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagcctt

SEQ ID NO: 174144 - DNA, 772 bp, Homo sapiens
  Payload ID: 14182
  Gene Symbol: RASSF8
  Gene Name: Ras association (RalGDS/AF-6) domain family (N-terminal) member 8
  ENST ID: ENST00000541218
  CDS Start-End: 148-772
agtctgaacgatgaccaatccaccacacgcacctacagtctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtc

SEQ ID NO: 174145 - DNA, 852 bp, Homo sapiens
  Payload ID: 14182
  Gene Symbol: RASSF8
  Gene Name: Ras association (RalGDS/AF-6) domain family (N-terminal) member 8
  ENST ID: ENST00000611440
  CDS Start-End: 109-438
ctgactacacagacttagtcttctccactccgtgttcctgcagctagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagaca

SEQ ID NO: 174146 - DNA, 1328 bp, Homo sapiens
  Payload ID: 14182
  Gene Symbol: RASSF8
  Gene Name: Ras association (RalGDS/AF-6) domain family (N-terminal) member 8
  Uniprot ID: Q8NHQ8
  ENST ID: ENST00000615708
  CDS Start-End: 150-1328
cggagctccgggtgccgccgcgtccccagcgccccggccggcccctctgggcggcctgcgggggcggcgcagttgcgaaactgactagagacatgacctaacaccctgatgaccactctcagggaccttgagtgactggccggtgcaccatggaacttaaagtatgggtggatggagttcagaggattgtttgtggagtcactgaagtcacaacttgccaggaggttgtcatagccttagctcaagcaataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacgcttacaggacaaagaacaggaactggagcagttgactaaggagttgcggcaagtcaatctccagcagttcatccagcagacagggacaaaagttaccgttttgccagcggagcccattgaaatagaggcctcacatgcagacattgaaagggggatcatcattctttctgataagcaggagtgtaaagattag

SEQ ID NO: 174147 - DNA, 5682 bp, Homo sapiens
  Payload ID: 14183
  Gene Symbol: RASSF9
  Gene Name: Ras association (RalGDS/AF-6) domain family (N-terminal) member 9
  Uniprot ID: O75901
  ENST ID: ENST00000361228
  CDS Start-End: 370-1677
gcttgtggggttggcagttctttaagtctgcaaataactacagaacacaatagagtcctcctcccttcctctctctctctttcttttttttttttcttttcctgcttccaaacgccttcttcgaggctgaagctgggcaggtctccagaggtgcagcagccacaacaatcccgcagttcaaagttaagcagcagttgcacaacttccagcaactttctcagccggctactaatgagctgaaagccaggaacatccgaggagaagagaaagcttccagccctcctcccttcaccctggaaatccagacacccccacccccaccctcagatcactttaagataatttctttattcgtttgcccgacagaccatggctccctttggaagaaacttgctaaagactcggcataaaaacagatctccaactaaagacatggattcagaagagaaggaaattgtggtttgggtttgccaagaagagaagcttgtctgtgggctgactaaacgcaccacctctgctgatgtcatccaggctttgcttgaggaacatgaggctacgtttggagagaaacgatttcttctggggaagcccagtgattactgcatcatagagaagtggagaggctccgaaagggttcttcctccactaactagaatcctgaagctttggaaagcgtggggagatgagcagcccaatatgcaatttgttttggttaaagcagatgcttttcttccagttcctttgtggcggacagctgaagccaaattagtgcaaaacacagaaaaattgtgggagctcagcccagcaaactacatgaagactttaccaccagataaacaaaaaagaatagtcaggaaaactttccggaaactggctaaaattaagcaggacacagtttctcatgatcgagataatatggagacattagttcatctgatcatttcccaggaccatactattcatcagcaagtcaagagaatgaaagagctggatctggaaattgaaaagtgtgaagctaagttccatcttgatcgagtagaaaatgatggagaaaactatgttcaggatgcatatttaatgcccagtttcagtgaagttgagcaaaatctagacttgcagtatgaggaaaaccagactctggaggacctgagcgaaagtgatggaattgaacagctggaagaacgactgaaatattaccgaatactcattgataagctctctgctgaaatagaaaaagaggtaaaaagtgtttgcattgatataaatgaagatgcggaaggggaagctgcaagtgaactggaaagctctaatttagagagtgttaagtgtgatttggagaaaagcatgaaagctggtttgaaaattcactctcatttgagtggcatccagaaagagattaaatacagtgactcattgcttcagatgaaagcaaaagaatatgaactcctggccaaggaattcaattcacttcacattagcaacaaagatgggtgccagttaaaggaaaacagagcgaaggaatctgaggttcccagtagcaatggggagattcctccctttactcaaagagtatttagcaattacacaaatgacacagactcggacactggtatcagttctaaccacagtcaggactccgaaacaacagtaggagatgtggtgctgttgtcaacatagttccaatggctcctttctgacctgctttcatgttttaatgtttgtttaatttaataggaaacctcattttaaatataacactcaaaaaaatgtaaatcatattgtagtattcaatagttaataaaaactcgagaaatgtgttgtttctgatgtgaaatttccaaaggaactttaattattgcaagttcaagcaatgaactatttatcacgaatgcagcacaaatagcttgtcgttgtagaacacagaaataatttgatgggaatcatatgataatcttccttagcgtctgtggaaaacgatttacataaactttaaaagcaatcctcaatattagacagtccaaatattcaaacatgaagaagtagaattaaaatgtgctgtaatatatatttttccaacactgtataattggaatttttaaatctgtaaagtatatgggagctactgtgttgtaactgcattaattcaaagtttggttcttttaattgatccttgataatacaacgtatcatgtatatcacttcctgaacccttctacctgttgaggcctatgaaacaggctgctgttgggacatgtataaatactggcagggaatcagacacgtatagggtacagatgaggcagggccaagtgctgcatacaaacagcaatttttataaagaagcctcaatttattaagagctatgtgtggatgtttgctatctggcaattcagatctcctgaccaaacccatgttcattcactgagtgaggtatagtgtgggttacagagaaaatcagtcatagtgttatttgtttatgtcctatctacaaaagttgcaatgatggaatttggaacccttctgtggataaaatagaatctgctataattattagcattttgtctctgaacctacagagaggagaccacatggacaaaagacttattctgctatgctataactcagattgtcttatttcttcatctaaagtgcttaaaagagacttagttcctaaaaaagtaccagcaaaatccccaacacactagtaagaattcaagaaattgaagggattatttaggtcttatcttgactgacaatcattattatggcctactatgcttgtgttttaattagaaatgtgctttcttctctctcccttctttgcttactttcttcttatttgccttcctgtctgccttacttcctctcttttcctgccttcatctctccttctcccgtcttctttttttcctttgcttccttcctgccaatgaacacatgatgcaatcataatgaaataattattttttattgtactgttaactgagtactgctgcagtttatttttatttagctgatatctttcctgtgtgtcactgcacatgtaagtagaaatattattttacttagttttaatatgtggacattggttaagggtcccaatccttctcatttcttctcttttattcttttgcatacttttagtgcaggttttaactcagttttcttattgttttactttcaaaatttgaaaagtatttaattttttaaagcaactttattgttaactcatttaaaaaaatatattgctccttaaatcttcttaacatatttgttcctgccttctcctgtcttttaactcatctttgggaagacatttagaattttctgattgtttcagtttcgtgagcatttatactatcatttcttgtaccaaaatagatattttcaggtcttatttcaagttggctggtaagaaaaatagaaatttccattctatggaaaaatacagtgataaagagtaataattctggcatcggttacatttttttaaaaaagataaaattgaatagtcatctgtgaaaggaaagttcacctgactaagagtccataaaattattcaacaatataagccactgacatattcattgttcactaatggggatcaaattcagaagatcatcgtaaatgataaacccattgtatcattttcctacagtggaagtcatctctttgaattattcttatctttagtgagaaaatactgaaagaacatgcttatctatttgactaattatctgaattcaagaggttctgataagaagtaggcctggagagataatttcatcttagaaactttgaattaacttctgcttttatacagttaagcacagtaatgcatttaaggctcaattcttctacattttacagtaaataatgtttgtaagtctcagaaagcagtaccattgctttttaaattcatttcagaatttccatttgctcattagttatacaaatgtatttgtgcgtttgatcactacaatcattaagttttaatccttcatcagctaccatggtgaacctcttaatttacagttacatgttaatatattaacacaaatagaagtactgaaatacaatgccctcatgtctggatactgaactatttgttattaaattaagtgagaattggaattataagtatagaacttgatagaaagtgtaatgttattatctatagaaatgttaaagtataaattcttgagtaatctgacaggttaactatgaaattgctatatgcagctagaagaaacaaaccaaagctgactattcttaatttctgtaacaggacctagattcatccttggtcatccttccacttggaattctcctttttatccttctgcaatgctctgaaatcttaccctttccacagtctttttaatgtgctagctcttctatgatatacgtttgttccattcaattagttggaatctcatctctgaacccagaaatattttagaggtacttctcataagaagcatttttattctggcttacgctatatatatttatgcacttacctaattcccctccttcaatgaattctattttttttttccttgagacggagtctcactctgtcgcccaggctggagtgcagtggcgcgatcttggctcactgcaagctccgcctcccggcttcacgccattttcctgcctcagcctcctgagtagctgggactacaggcgcccgccaccacgccaggctaatttttttgtatttttttagtagagacggggtttcaccgtgttagccaggatggtctcgatgtcctgaccttgtgatccacccgtcttggcctcccaaagtgctgggattacaggcgtgagccaccgtgcccgaccaatgaattcttattaaattactttatcatctgtcttgttagccttactctttcctattaacttctttgccccctgctccctttttgaattgagtggctaaattttagaggtttgtagcttttgtgtgtgtgtgtgtgtgttttatagatggtaaatgatgcttgtacattttgtacatgaatgaatacgtattttagcagacttaaaacattaacagtaattgaccttatacattttgggaaagaaaaattaaatcttcatgctactacgatttttttaaatgtggcatcaatgtttatttttaataatagtattactgacttaataaaccccaaatgtctctttaagctgatttaatggttatattatagaattttttatttcattgtgtgcttatgagaaaaaacatattttagagttgggttttaaatggtagacacagaaagtaactttaaaatatcctaaacaaaatatctatttcatttttcttcttaagtaaaataacaacacctcattagtgtgtagaagctattctaatccattaaaattttatttttatatttatttaaatatctactgtacatgacaaaatatatttctgtggctgccttttataattattttccaagtagacataatctatttaaaacatatttttctagtgacaaagaaatacattttatcctgatatatagtttttaaatactaggctatttcttttcatactgcctgattggtttaataaacatgatgtgacaaatattaagtatatatcattttatcatgttgtaactgatccaaaataataaaagaaataattatacctttcttgtg

SEQ ID NO: 174148 - DNA, 1757 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000327761
  CDS Start-End: 146-958
gcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgc

SEQ ID NO: 174149 - DNA, 1864 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000357043
  CDS Start-End: 37-1071
cgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 174150 - DNA, 1923 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000359365
  CDS Start-End: 108-1130
cagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 174151 - DNA, 1745 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000395117
  CDS Start-End: 37-315
cgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 174152 - DNA, 1657 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000395126
  CDS Start-End: 295-864
caactgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 174153 - DNA, 1711 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000482447
  CDS Start-End: 108-566
cagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcc

SEQ ID NO: 174154 - DNA, 1842 bp, Homo sapiens
  Payload ID: 14184
  Gene Symbol: RASSF1
  Gene Name: Ras association (RalGDS/AF-6) domain family member 1
  Uniprot ID: Q9NS23
  ENST ID: ENST00000616212
  CDS Start-End: 478-1047
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctc

SEQ ID NO: 174155 - DNA, 5282 bp, Homo sapiens
  Payload ID: 14185
  Gene Symbol: RASSF2
  Gene Name: Ras association (RalGDS/AF-6) domain family member 2
  Uniprot ID: P50749
  ENST ID: ENST00000379376
  CDS Start-End: 55-1035
aatgctgtgagttccttgttaggcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaag

SEQ ID NO: 174156 - DNA, 5427 bp, Homo sapiens
  Payload ID: 14185
  Gene Symbol: RASSF2
  Gene Name: Ras association (RalGDS/AF-6) domain family member 2
  Uniprot ID: P50749
  ENST ID: ENST00000379400
  CDS Start-End: 197-1177
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcagcctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagaga

SEQ ID NO: 174157 - DNA, 1099 bp, Homo sapiens
  Payload ID: 14186
  Gene Symbol: RASSF3
  Gene Name: Ras association (RalGDS/AF-6) domain family member 3
  Uniprot ID: Q86WH2
  ENST ID: ENST00000283172
  CDS Start-End: 121-393
gctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaa

SEQ ID NO: 174158 - DNA, 1030 bp, Homo sapiens
  Payload ID: 14186
  Gene Symbol: RASSF3
  Gene Name: Ras association (RalGDS/AF-6) domain family member 3
  Uniprot ID: Q86WH2
  ENST ID: ENST00000336061
  CDS Start-End: 44-760
gctgcataaggactgcccggggctgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgct

SEQ ID NO: 174159 - DNA, 3492 bp, Homo sapiens
  Payload ID: 14186
  Gene Symbol: RASSF3
  Gene Name: Ras association (RalGDS/AF-6) domain family member 3
  Uniprot ID: Q86WH2
  ENST ID: ENST00000542104
  CDS Start-End: 121-837
gctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatttattgtgaaggattttgttagggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagttacatagtgtatagctttccccccacaggtggttttcaaagttgagacggaatttgggtaggggcagctgtttttcccttgattgttagctaggatatttgtcaagtaaactttggtgacaatcactctcttcccttttattcctcctttccttttcctttcttcccttttttctttccttccctgctgtctcccaccctaccttgttcttttcctccctccctccctccctccctccctccctccctccttccctccctctctctccctctccctttcttttctacattgaaatctgttcttacataatagagaacagggctattgaataaagacccaatcctaccagatctttagttctaaagggcaacttgactgtgagtaggagggcccccaagaaagggaggaaagtccacacccagctaaccacacaacagggcttcattatggaaatattttaacaaaagtacatgttattaccaaccaaagagatgcatgtgcaatagaagccttccttaaaaacaggctaaataacctcattttatgcagcagtttaatctgagaacagagggaaaggtgtgcagtggttccagaggggccttatattctatttttagtctagatattttttgtttataaattcccaaggaattgttaacactttggtgacacctaatggattctttttgaaattccaaggtgcttcagttctttgcccaagtgaactgtgccttttattgcatttctgttcgtctcttggtggctcttctgactttttggagaatacccatcttgttggaggcagacttaagttgttatgctgtgccacacaatttactgagacaatcatatcttcctaagcatttaaggaaagttgaaaaaaatagaattagctataaaatatgtatggcacatcttgtttaattttgcatgtaacttctcttttgtacattgatgaggttttagtgacattgtcatccaacactttacctttattgttcagggaatgccttcgtgattttttgtactggttttattattcagactatggcctggatttgagtatattgttattaccacctggttttttaattattcatcccagtaaacttatattttgtgaagcatttgtttctcagattaagacactgttagaacctaaagtagtagctgatgggtatctgtgaattttttttttttttttttttttacttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaattgaagttattagtt

SEQ ID NO: 174160 - DNA, 3641 bp, Homo sapiens
  Payload ID: 14187
  Gene Symbol: RASSF4
  Gene Name: Ras association (RalGDS/AF-6) domain family member 4
  Uniprot ID: Q9H2L5
  ENST ID: ENST00000340258
  CDS Start-End: 114-1079
cgctgcgggcgcagctccggtgcaagcgaggacacgacacatgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtcgctcagtacattaagtttgaaatgccggtgctggacagttttgttgaaaaattaaaagaagaggaagaaagagaaataatcaaactgaccatgaagttccaagccctgcgtctgacgatgctgcagcgcctggagcagctggtggaggccaagtaactggccaacacctgcctcttccaaagtccccagcagtggcaggtgtacactgagccctggttgctggccccggccggtcacattgactgatggccaccgcctgacgaatcgagtgcctgtgtgtctacctctctgaagcctgagcaccatgattcccacagccagctcttggctccaagatgagcacccacaggaagccgacccaggcctgaggggccaggaacttgctgggtcagatctgtgtggccagccctgtccacaccatgcctctcctgcactggagagcagtgctggcccagcccctgcggcttaggcttcatctgcttgcacattgcctgtcccagagcccctgtgggtccacaagcccctgtcctcttccttcatatgagattcttgtctgccctcatatcacgctgccccacaggaatgctgctgggaaaagcagggcctgccagcaggtatgagatctagcctgctttcagccatcaccttgccacagtgtccccggcttctaagcctccaatatcaccctgtgagcctcgcacagctcagccccaacacagaggtgagaccaggaataaggccacaagtatctcactttctctgcagaaatcaatctttacttcatcagagagacctaaagcgattcttacaaggagcttgctgcaagaaacacggtcattcaatcacattgaggagggtccacatggcattgagagggtgctgcccgctcaatgcccagcagcagctctggaaggcagtgctcagccccatcaccactgtcccgtggatgcctgtgtacctcttgccttttctgggcttgcgtttctctcctctagtgggtggggatgactttcaatgactttcaatacttcccctgaaggaagaatgataaggagaaatgtctgttttgaggaaagggctttgaattccccagatactgaacaatttgtgtttgtgactgatggagaatttcaggaatgaatgagaaagcctttgcgaaactatgcaacagtttacatcagtcatgtgaagtatttgtctaaaacagagcaaactgaagaccaaattattctcctgttgaggtccgtggatggcagatttaaagggaagaaccacaaaggcttgcaaagataggagaggctccatctctaatgcatgtagaagctccttacgggtgcccatcaagagcatagcttggaagccaccatgctgtgcggaactgcgtcagggcaaatgtcacagcaggatttccccaacccagctccatcatcacagacacagagagctgcaggggaggcctgcccactgttttgtcgactctgccctcctctggcagcatagatccttaggtgctcaataaaggtgtgctgtattgaactgaagaagtgagaaccaagcttttttttttttttttgctttctgtgcatccaccctgacccccggctctaacttctgaaactcttatcctaaaggatgtgtggccatgtttggcagaagagccacaactcgctgctctaggagccgacatgactccttcatttctgtgcatgccctggggactagggtggagcctgaggagaggctgccatggaacacgcaggcgtcactggtgggagcctagaggtgacctggatgatgagcaatagagtcaccccgagtcacagaatcttagcatcaggagggccccaagaatcttccaggccaggggctcaggtgggatggaagcagggcctaggagagggtacaaaacaaatcaaacaggagctcccaggtaattgtactcccaagctattatttacaatctcaggtggaggacagctcctgtcccattgttcagctgtaactgagtgactgccttgtgccaggcctgtgctcagccctggaggcacaaagatggagccagtctgtcctgtgtctaggggtcttctcatcaggagaagaaggccagacactggaagggtcaagagatcagctgagcaacgaaccggcaaagctcctgggagtgaggtggaggccaaggcagagttggctaagaagtgcatgtggcgtcacaggccaagatgcacctgccagctaggagcaggccaggtcctggcacacaggaagccagtggagcaggagaccctccctaagtaccagcctgtttggttggttggtttgcttttgaaagttattacaatattatttaaggccttttcggataagttcacttttaaagtaggtgttatcaatctaatttctgaacgttatgggtcagaaaaatcactagcaagtggctcagaaaaagggaaaaggtacacttctgcaatcagctgaggagttcacacctttttttctaaatcaacatcatatttgctgttcagaggcaatctgaaaagctgcaaattcagctcacctcaaccccataatttcaaacgttagaggctggtctctgtggtttcctactggttcctgtggggagctcccgctttctttctacatagagcttagggtatttctcatatgccccattggctacctagtgtctcaggtaataaacgtatccgaagataaagcaaa

SEQ ID NO: 174161 - DNA, 528 bp, Homo sapiens
  Payload ID: 14187
  Gene Symbol: RASSF4
  Gene Name: Ras association (RalGDS/AF-6) domain family member 4
  ENST ID: ENST00000427758
  CDS Start-End: 75-528
catgcagtggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctgggctgctggtctcttctccttggcctgagctccctttctctgccggcagccatctcagccctgcagttgtctgttttcagaaaggagccatcgccccagaacgggaacatcacagcccaggggccaagcattcagccagtgcacaaggctgagagttccacagacagctcgg

SEQ ID NO: 174162 - DNA, 435 bp, Homo sapiens
  Payload ID: 14187
  Gene Symbol: RASSF4
  Gene Name: Ras association (RalGDS/AF-6) domain family member 4
  ENST ID: ENST00000428466
  CDS Start-End: 1-372
agttctcacgtgcccatcagtgacagcaagtccattcagaagtcggagctcttaggcctgctgaaaacctacaactgctaccatgagggcaagagcttccagctgagacaccgtgaggaagaagggactctgatcatcgaggggctcctcaacattgcctgggggctgaggcggcccatccggctgcagatgcaggatgaccgggagcaggtgcacctcccctccacctcatggatgcccagacggcctagctgccctctccaccttgctggcaagaagggacgactacagccaggggggctcccaacacctatgcaagccgaacatgtctcgccatctcttgttctatctttaaaattcacacgaatttagcctcttactactctgttttcattttaatgtcaaaattttaaaaataaatttatcagaatttca

SEQ ID NO: 174163 - DNA, 734 bp, Homo sapiens
  Payload ID: 14187
  Gene Symbol: RASSF4
  Gene Name: Ras association (RalGDS/AF-6) domain family member 4
  ENST ID: ENST00000483709
  CDS Start-End: 67-216
ggcttctggactgcgcgatgactggacgcaagtaacttctaggtctgcagacaagaggaagagaagatgaaggaagactgtctgccgagttctcacgtgcccatcagtgacagcaagtccattcagaagtcggagctcttaggcctgctgaaaacctacaactgctaccatgagggcaagagcttccagctgagacaccgtgaggaagctcagtgacacatctgtgcttgtagagcaccagaagaagggactctgatcatcgaggggctcctcaacattgcctgggggctgaggcggcccatccggctgcagatgcaggatgaccgggagcaggtgcacctcccctccacctcatggatgcccagacggcctagctgccctctaaaggagccatcgccccagaacgggaacatcacagcccaggggccaagcattcagccagtgcacaaggctgagagttccacagacagctcggggcccctggaggaggcagaggaggccccccagctgatgcggaccaagagcgacgccagttgcatgagccagaggaggcccaagtgccgcgcccccggtgaggcccagcgcatccggcgacaccggttctctatcaacggccacttctacaatcataagacctccgtgtttactccagcctatggatccgtgaccaatgtgagggtcaacagcaccatgacaaccctgcaggtgctcaccctgctgctgaacaaatttag

SEQ ID NO: 174164 - DNA, 491 bp, Homo sapiens
  Payload ID: 14187
  Gene Symbol: RASSF4
  Gene Name: Ras association (RalGDS/AF-6) domain family member 4
  ENST ID: ENST00000484477
  CDS Start-End: 1-253
gacaaccctgcaggtgctcaccctgctgctgaacaaatttagggtggaagatggccccagtgagttcgcactctacatcgttcacgagtctggggagcggacaaaattaaaagactgcgagtacccgctgatttccagaatcctgcatgggccatgtgagaagatcgccaggatcttcctgatggaagctgacttgggcgtggaagtcccccatgaagtgagtgggggccaaggctggggaggcctgctctagggtgaggggttcttgggtgacggggcctcccaaggactcctggccagagccctgtcagttgatgtctccaggagctccacactctcccaaagggctcccagcctagcacagggaggcgccagccctccctctcccatcagtgaccgccagcaccagcagcttaggggaaagaagaatttgggtcctataaaaccatggcctgtccttttcctctagggaagtaaagtcttttccttca

SEQ ID NO: 174165 - DNA, 2064 bp, Homo sapiens
  Payload ID: 14188
  Gene Symbol: RASSF5
  Gene Name: Ras association (RalGDS/AF-6) domain family member 5
  Uniprot ID: Q8WWW0
  ENST ID: ENST00000579436
  CDS Start-End: 74-1330
tctctcggggctggctcgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaa

SEQ ID NO: 174166 - DNA, 1932 bp, Homo sapiens
  Payload ID: 14188
  Gene Symbol: RASSF5
  Gene Name: Ras association (RalGDS/AF-6) domain family member 5
  Uniprot ID: Q8WWW0
  ENST ID: ENST00000580449
  CDS Start-End: 58-1068
cgggagtagcgcagtcgccaaagccgccgctgccaaagctgccgccactagccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaa

SEQ ID NO: 174167 - DNA, 3496 bp, Homo sapiens
  Payload ID: 14188
  Gene Symbol: RASSF5
  Gene Name: Ras association (RalGDS/AF-6) domain family member 5
  Uniprot ID: Q8WWW0
  ENST ID: ENST00000577571
  CDS Start-End: 410-1207
gaactgctttacgcgaggggcaggaaaggcgcgggaggcgggggaggtgcggagatggcgctctgcacggcggcggagggagggcgctggcgccggggacacgaaaccgcagagcccggacgagtcagggagtgaggcgcgagccgggcgcccggggctctgcaggcgcaggcggcgcggggacaggagcaggttaccgggccgcccgagcgctcgcaccccgctgaaagaaacgcaggcggcccgccggctctgcctggtccgctacccgaccagctcccggctcggggctcagagctaggggcttacgccaagcggagcccggggaggggtgcccacctccctccgccgcatcccaagcccggcccccttgatgcgctggcggcctcggccgggaactccggggtagatgaccgtggacagcagcatgagcagtgggtactgcagcctggacgaggaactggaagactgcttcttcactgctaagactacctttttcagaaatgcgcagagcaaacatctttcaaagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgc

SEQ ID NO: 174168 - DNA, 5586 bp, Homo sapiens
  Payload ID: 14188
  Gene Symbol: RASSF5
  Gene Name: Ras association (RalGDS/AF-6) domain family member 5
  ENST ID: ENST00000581503
  CDS Start-End: 9-1061
agccgggcatggccatggcgtccccggccatcgggcagcgcccgtacccgctactattggaccccgagccgccgcgctatctacagagcctgagcggccccgagctaccgccgccgccccccgaccggtcctcgcgcctctgtgtcccggcgcccctctccactgcgcccggggcgcgcgaggggcgcagcgcccggagggctgcccgggggaacctggagcccccgccccgggcctcccgacccgctcgcccgctccggcctggtctgcagcagagactgcggcggcggcctggagcgccccgaccccgcgacgtgcggagcatcttcgagcagccgcaggatcccagagtcccggcggagcgaggcgaggggcactgcttcgccgagttggtgctgccgggcggccccggctggtgtgacctgtgcggacgagaggtgctgcggcaggcgctgcgctgcactaactgtaaattcacctgtcacccagaatgccgcagcctgatccagttggactgcagtcagcaggagggtttatcccgggacagaccctctccagaaagcaccctcaccgtgaccttcagccagaatgtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaaggtaggagaaagagtgaacccaaccagaccgttcccttcctacctgtgtccaagcccacccactaaaactcctgccggccttgggtgggagctgtgggcttctcctgagcaccaggggtccagctgcccatgtggtgttcagatctgtggaatccgggcagggaggcaagagcagagtccctgactctgcatgtgacttcaggaaaaccacaccctaggctcccatttcctgatctgtgcaatgggaggaatctgccccaccattcctaatctttcaggagatgatgtgaatggaatcatgctttaaactctgagcagacacccaagataaaaggttattgccctgttcattactgtcatgttcatttcattaaaaggcccgtgtctacttccagttgtacgtaccccacctctgcatttccaatcctttcccgcaagcctgggccccgcccttcttttctgggaagagctcccagcaccctctcttggtttgcagtgctcttccagaaactctccattgctgaccgccccctctacctgcgcctgcttgctgggcctgacacggaggtcctcagctttgtgctaaaggagaatgaaactggagaggtagaggtaggtctggacccattgtgcaaacccaggccttagggcaccctgggtgggtgcaggtgggtgttgtcctaactacctcacataggtgggagccacgcagcacgggcaggaaggtgactgttgagagagtgagcaggggtgggtgatgggcctgggggtcagtgtttcagccaggactctgaacaccctggggtagcacattagggcctgtgtgtggcaaggcctgtggaaagaaaggatttcatgtgctttatttctgaaaactcagggaggagggggaccaagaaactccctgtgctcaggcacaggctgtttttgcttcaaaatggcccgagggctaccaagctccatctctgggctccactgggtatagacgtttttgagccatttgtcctcccttttcttgacctccatcccccaaggggagctaaccagtgtgtagtcttgtggcataaactggagtaaaaccaggccggtgccacccatggcctgagaatgaccaacaggggaaggtctcagtgtttgtcacactgtgttcagtggaggcctagagttttaaggagttttgggagtcactgcggagatttagggatcaaggcagctgggactctgtcccttctccccatttcagcaagggccgctctgctcccatctgctttctttattggcatctgtgcagaatatgtttggaaaaagtactccatggacagtagctgaatgctgctggccctgtggaaagctcaggcactttgaagtgtggagacctgggctctagttccagttctgctgcaatgagctctgtgattgtgattacgccaccttccctgtgtggacttgaggtttctcacttatccatagcgaggaccaaaccagataaaccttagtactctattgtgctcaaagagcttaggagtctcaattgttggccgcacagggcttgtgctcttgggtcagcctgatggaagtccaaattgccttctgccatcagaggccaagtcctttaggggtaggcctgggccagtcaggctctcattatctgctctgccagtcatgggaggtagataccccaatttcccagcagataacaggctgagaagggtggaaagctgtgctcgaggtcacactgctgggagaggtggagtcaggcccaaccccggtctcctgagtccacgttccactcctccacctgctttctgagggtctgcatgttgggaggctgggtggttccagcatcactgtcaagatctcggctgctacacagaaacttaagattattgagtttcaaaataaaaacatggttcatagactggcaactcttggtcatgagatgccagcatttggaattttgttgctgctatgacaggcatgcaaagcccaggcttcgctgattcagtctgttcagtagcaaactgtgtgtgaatcacggatgtgaactgggaaggggaaggcagcagggtctctcaggtcgtgtcaacttctaacctgtctcctattctgtttcttcccacaaatctccctctcgcctcacagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatg

SEQ ID NO: 174169 - DNA, 4499 bp, Homo sapiens
  Payload ID: 14188
  Gene Symbol: RASSF5
  Gene Name: Ras association (RalGDS/AF-6) domain family member 5
  ENST ID: ENST00000581888
  CDS Start-End: 1-558
gtctgtaaacctgtggaggagacacagcgcccgcccacactgcaggagatcaagcagaagatcgacagctacaacacgcgagagaagaactgcctgggcatgaaactgagtgaagacggcacctacacgggtttcatcaaagtgcatctgaaactccggcggcctgtgacggtgcctgctgggatccggccccagtccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaagtgctcttccagaaactctccattgctgaccgccccctctacctgcgcctgcttgctgggcctgacacggaggtcctcagctttgtgctaaaggagaatgaaactggagaggtagaggtaggtctggacccattgtgcaaacccaggccttagggcaccctgggtgggtgcaggtgggtgttgtcctaactacctcacataggtgggagccacgcagcacgggcaggaaggtgactgttgagagagtgagcaggggtgggtgatgggcctgggggtcagtgtttcagccaggactctgaacaccctggggtagcacattagggcctgtgtgtggcaaggcctgtggaaagaaaggatttcatgtgctttatttctgaaaactcagggaggagggggaccaagaaactccctgtgctcaggcacaggctgtttttgcttcaaaatggcccgagggctaccaagctccatctctgggctccactgggtatagacgtttttgagccatttgtcctcccttttcttgacctccatcccccaaggggagctaaccagtgtgtagtcttgtggcataaactggagtaaaaccaggccggtgccacccatggcctgagaatgaccaacaggggaaggtctcagtgtttgtcacactgtgttcagtggaggcctagagttttaaggagttttgggagtcactgcggagatttagggatcaaggcagctgggactctgtcccttctccccatttcagcaagggccgctctgctcccatctgctttctttattggcatctgtgcagaatatgtttggaaaaagtactccatggacagtagctgaatgctgctggccctgtggaaagctcaggcactttgaagtgtggagacctgggctctagttccagttctgctgcaatgagctctgtgattgtgattacgccaccttccctgtgtggacttgaggtttctcacttatccatagcgaggaccaaaccagataaaccttagtactctattgtgctcaaagagcttaggagtctcaattgttggccgcacagggcttgtgctcttgggtcagcctgatggaagtccaaattgccttctgccatcagaggccaagtcctttaggggtaggcctgggccagtcaggctctcattatctgctctgccagtcatgggaggtagataccccaatttcccagcagataacaggctgagaagggtggaaagctgtgctcgaggtcacactgctgggagaggtggagtcaggcccaaccccggtctcctgagtccacgttccactcctccacctgctttctgagggtctgcatgttgggaggctgggtggttccagcatcactgtcaagatctcggctgctacacagaaacttaagattattgagtttcaaaataaaaacatggttcatagactggcaactcttggtcatgagatgccagcatttggaattttgttgctgctatgacaggcatgcaaagcccaggcttcgctgattcagtctgttcagtagcaaactgtgtgtgaatcacggatgtgaactgggaaggggaaggcagcagggtctctcaggtcgtgtcaacttctaacctgtctcctattctgtttcttcccacaaatctccctctcgcctcacagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgagggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggcattgattcctctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaaactgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggtgcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctctgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaa

SEQ ID NO: 174170 - DNA, 5994 bp, Homo sapiens
  Payload ID: 14189
  Gene Symbol: RASSF6
  Gene Name: Ras association (RalGDS/AF-6) domain family member 6
  Uniprot ID: Q6ZTQ3
  ENST ID: ENST00000307439
  CDS Start-End: 296-1309
ccaggatcgctgatcgcgtcgggggcactgcaagcgcccagctgagccatgctctgggaggagacaggcgccgcccctgcgcccgcgcgggcctcggacctcccctacaggtgagtgactcgcggagtcccagcccggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagccggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctctaaaaaaaaaaaaagagggaaataaacatttatttgtatattgttatgtagccattaaaattctgtttccaagtaattttaattacaggggtaaattcttatatatctaaataagaatatacacatacacatgttccaaaatatttattatgtacttaaggcatatatattatatatgtatgtgtgtgtatatatatatgtatttgtgtgtgtgaacactaatatttgcatatatatacacacaagaaataaaaacatgttaaaaatggctatatctgcattgtagaattatgagtgattcatgtttttctaacttccctatctgtattaagtgttctatagtttatatttgttactttttacatcaggaaatagtaaagttattatttaaaacttatgaacaaaaaagtaacaagcacatgcaagcacagagttctaccaaatgcaaaaaatttcaaatcaattattcaaatgagacattaacatcacttctgtggtagttttatatccataaagtctgattcttctcctttgaagagatgaagcttaatcttcctcatcctgaaaatgggctggacttagtgacttacgtctttttattttatttttaattgacaaataataattgtatgtatttatggggtacaatattatattattatatatgtatacattatggaattattaaatcaagctaattaacatatccataacctcttataatttctttgtggtgagaacatttaaaaatgtactcttttagcaattagggacttacttttaatacaggaaaatggaagagactgtgagactttgaagtaggtcataaaagtcactgtggcttcctccttgctctctcttggaccacttgctctgggggaagtcaactgccatgtcctgagcagccctggaaagacctacatgatgaagaactgagaccttctatcaaatgccagcagggaattgaggcctcctgtcaacagccattttagaagtagatcttccagcctcagtcaagccttcagatgactgcagccctgtctaatagcttgaccgtaatttcatgagagaccttcagccagaaaacccaaggaaaccattctggattcctcatcctcagaaactgtatgagataagaagtgtttgttgtagtacgccgctaaatttggggcaatttgttacatagcaatgtatagctcatacaatttctgggaaaaaaatagtttattttcgaatcatttttgcataatgcaagaatataaacttgtcacagaataatttatccttgttttaggtggtccaaatatttcattgtcagttatatattagctcaaattaaattttagataatatatattattattaatggtaaagaatgtgtcacatttatctttatagcttttctgtacctaatattgtgtcttgtgcgtaggatgtgctcaataaaaattgattgaataaataagtgaatgaaagaataaatgaatgagtgaaggaattatctgaaatatttttataaaattccccatatgtatgtattacttattacaagtctggtcccatagctgaaaaaatattaaacattatatatatata

SEQ ID NO: 174171 - DNA, 1360 bp, Homo sapiens
  Payload ID: 14189
  Gene Symbol: RASSF6
  Gene Name: Ras association (RalGDS/AF-6) domain family member 6
  Uniprot ID: Q6ZTQ3
  ENST ID: ENST00000335049
  CDS Start-End: 1-978
atgctctgggaggagacaggcgccgcccctgcgcccgcgcgggcctcggacctcccctacagaattcacttcctgtcctctggcctcattctggtcacaaggcaactgactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaa

SEQ ID NO: 174172 - DNA, 4331 bp, Homo sapiens
  Payload ID: 14189
  Gene Symbol: RASSF6
  Gene Name: Ras association (RalGDS/AF-6) domain family member 6
  Uniprot ID: Q6ZTQ3
  ENST ID: ENST00000342081
  CDS Start-End: 132-1241
actgaggcacagggagtggctcaggtttcttgacacttccctgctgtggcgaaaaggagaaataattaacagctcctggggctccaggatcgctgatcgcgtcgggggcactgcaagcgcccagctgagccatgctctgggaggagacaggcgccgcccctgcgcccgcgcgggcctcggacctcccctacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagccggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctct

SEQ ID NO: 174173 - DNA, 2735 bp, Homo sapiens
  Payload ID: 14189
  Gene Symbol: RASSF6
  Gene Name: Ras association (RalGDS/AF-6) domain family member 6
  Uniprot ID: Q6ZTQ3
  ENST ID: ENST00000395777
  CDS Start-End: 160-1071
ggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaa

SEQ ID NO: 174174 - DNA, 3689 bp, Homo sapiens
  Payload ID: 14190
  Gene Symbol: RADIL
  Gene Name: Ras association and DIL domains
  Uniprot ID: Q96JH8
  ENST ID: ENST00000399583
  CDS Start-End: 189-3416
cccgccccgcccgttgcgccgccggcaggaggcgccgcggcacgcgcgggtctgggcgccggccccagccaacggcgggtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcacgacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 174175 - DNA, 567 bp, Homo sapiens
  Payload ID: 14190
  Gene Symbol: RADIL
  Gene Name: Ras association and DIL domains
  ENST ID: ENST00000457174
  CDS Start-End: 166-567
ggaagcgggcagcgtgtgaacaagtgggcaccctctggtctggccaagggaggatgaccaaacggagagaaatgctttctgaaaatcccaaaacagataaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgttt

SEQ ID NO: 174176 - DNA, 5669 bp, Homo sapiens
  Payload ID: 14190
  Gene Symbol: RADIL
  Gene Name: Ras association and DIL domains
  ENST ID: ENST00000445392
  CDS Start-End: 124-1347
cagccaacggcgggtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcaccctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttcttagagggtgccctgctggggtctcaactcgggcagcaggcgtgggctgctcggaggggccgcaggggctccccatggcctctgcctgccaccggcacgggagaatgcagtgacagctgtcatcaggggatcatctgaactgactctccctgcccccgtcccacccagacacagggcactgcaggaagcagctccaacagcccctcccagctgaagcagggccagacctggcagaggatgctggacttctgatcccgctgctcagcacaggccccagagaaaggtctagacacccaggcgttggaaagtggaccggcctgatggtctctgaggcgccgagcccaccctgggccctgcttcctctcccaggactcctgctccctcctgagttcctctcccctactaaagccaccagcgtggccctgataccaggctggcggccccaggcccttaatcctcaccagcgtccccctggccaccggccctaacccgggcaggaggccagcgtccctctccaccagctggctgaccatgcgcaggaccagggcagggcacttgctgcctcggggtgacagcgtgggtcgctgggcatcctcagcagctccaccaactgggtgtgggtggcttccgcgccctcctggctgtggtggaactggtggcccagggtcatctttgatagcaacagagaaaccctggggaagagggtcccggcatcagttgcagatgcacctctcactgggacagaggtctgtgcggggtccccagatcggtgtcctgggtctgtcccaggccctgggcctcgtgcagctccacgctgccccctggtgtgcgctacggcgaggtgcagcgcgtccgccccgcgccctctgccgacccgcagttctgtgtgcggctccgcattgcgcctggctcgaaacggcgaccactgccaggttcccaaaatactggataaaatatatatatatatatagtgtttgtatatatatttaagatatgtaaaatatatgaatatatataaatatataattatatatgaatatattacatattcatgtatacgtaatatattcgtatattttataaacattttttatattttattatataaaatataaatatttaatttttttttatgagacggagtctcgctctgtgacccaggctggagtgcagtggtgcaatctcagctcactgcaacctccacctcccaggttcaagcaattctcctcagtctcctgagtagctgggattacaggcgcctgccaccacgcttggctaatttagtacttttagtagagacagggtttcaccacgttggccaggctgatttcaaactgacatcaagtgatctgcccgccttgccctcccaaagtgctgggattacaggcgtgggattaccatgcctggccttgttctgtttcttttcctaggagtcccacaacgtgtgtgttagcactgccgagaatgtctcacagctctggacggtctgcatttctggacctggtgcagatcccaggatcctggactctgatttgatgccttaacggtggaagggggttgagtatattttttatgtgggaggggtgtggactgtggccagaggaaagacagtggcaaggcatttccaaaggtggccaccaacagttcctcccacaaagagaagggggcttatctcttcttccctgcaatattctccggccttctgacttgctccgaacaacaggatgcagcataagtgatattctgggaccttccaagccagactgaagggcctttggtttctattttcatgctcctggaactcagcatccatggaaagaagctcttggcatcaccccaaggaagggaggccccgtggagtcggggaggcccagctagcctctggccgctgaagcacctagctgaggtgcgggactggtgagggctgccactggctgttctggtcttgctgagcttccaggcgaatgcagtcccaccagtgatcccggggacaccacgtggagcagaacgacttcccagccaggccccagacaatctacaacactgtgaaagg

SEQ ID NO: 174177 - DNA, 1485 bp, Homo sapiens
  Payload ID: 14191
  Gene Symbol: RCE1
  Gene Name: Ras converting CAAX endopeptidase 1
  Uniprot ID: Q9Y256
  ENST ID: ENST00000309657
  CDS Start-End: 45-1034
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggccttgggcctttggg

SEQ ID NO: 174178 - DNA, 1270 bp, Homo sapiens
  Payload ID: 14191
  Gene Symbol: RCE1
  Gene Name: Ras converting CAAX endopeptidase 1
  ENST ID: ENST00000525356
  CDS Start-End: 217-837
gccgcgggccccctgaacttactgtcccctccgtagggaccatcccgcggtcatcaagcgacgcttcaccagcgtcctggtggtgtccagtctctcacccctgtgcgtgctgctctggagggaactcacaggcatccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaaca

SEQ ID NO: 174179 - DNA, 1428 bp, Homo sapiens
  Payload ID: 14191
  Gene Symbol: RCE1
  Gene Name: Ras converting CAAX endopeptidase 1
  ENST ID: ENST00000524849
  CDS Start-End: 6-314
gcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggc

SEQ ID NO: 174180 - DNA, 1379 bp, Homo sapiens
  Payload ID: 14191
  Gene Symbol: RCE1
  Gene Name: Ras converting CAAX endopeptidase 1
  ENST ID: ENST00000524506
  CDS Start-End: 20-946
cgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaaca

SEQ ID NO: 174181 - DNA, 5023 bp, Homo sapiens
  Payload ID: 14192
  Gene Symbol: RASGRP1
  Gene Name: RAS guanyl releasing protein 1 (calcium and DAG-regulated)
  Uniprot ID: O95267
  ENST ID: ENST00000310803
  CDS Start-End: 179-2572
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaa

SEQ ID NO: 174182 - DNA, 2296 bp, Homo sapiens
  Payload ID: 14192
  Gene Symbol: RASGRP1
  Gene Name: RAS guanyl releasing protein 1 (calcium and DAG-regulated)
  Uniprot ID: O95267
  ENST ID: ENST00000450598
  CDS Start-End: 8-2296
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 174183 - DNA, 2151 bp, Homo sapiens
  Payload ID: 14192
  Gene Symbol: RASGRP1
  Gene Name: RAS guanyl releasing protein 1 (calcium and DAG-regulated)
  Uniprot ID: O95267
  ENST ID: ENST00000414708
  CDS Start-End: 8-1453
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 174184 - DNA, 5021 bp, Homo sapiens
  Payload ID: 14192
  Gene Symbol: RASGRP1
  Gene Name: RAS guanyl releasing protein 1 (calcium and DAG-regulated)
  ENST ID: ENST00000539159
  CDS Start-End: 179-2572
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctatatcctgatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctac

SEQ ID NO: 174185 - DNA, 1910 bp, Homo sapiens
  Payload ID: 14192
  Gene Symbol: RASGRP1
  Gene Name: RAS guanyl releasing protein 1 (calcium and DAG-regulated)
  Uniprot ID: O95267
  ENST ID: ENST00000559830
  CDS Start-End: 8-1801
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 174186 - DNA, 2707 bp, Homo sapiens
  Payload ID: 14192
  Gene Symbol: RASGRP1
  Gene Name: RAS guanyl releasing protein 1 (calcium and DAG-regulated)
  ENST ID: ENST00000561180
  CDS Start-End: 87-2633
ctattgagattatcagcactatcacctggacaagcagcggatgggccgcccctcttggccaggtcttctgtgcgcactgacgttgtatgaaagttgtccccacatctcctacacccaccgacgccaggcggccgcgtctgggccagatatggatcacgcctgtggagcgcacctccacacaggcagccctcgtccaaggtgcagggcgcagggcacagggcacatgtctacggcccagtcctgcagacggctacctagagaccccagggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctga

SEQ ID NO: 174187 - DNA, 304 bp, Homo sapiens
  Payload ID: 14192
  Gene Symbol: RASGRP1
  Gene Name: RAS guanyl releasing protein 1 (calcium and DAG-regulated)
  ENST ID: ENST00000560929
  CDS Start-End: 208-304
ggcgtggaagctgcgggtcggctgcgggaaagggggtcccatgggagccgctaggcgcagcccgtttcccgagctgaggtggaggtcgacgggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtc

SEQ ID NO: 174188 - DNA, 2895 bp, Homo sapiens
  Payload ID: 14192
  Gene Symbol: RASGRP1
  Gene Name: RAS guanyl releasing protein 1 (calcium and DAG-regulated)
  ENST ID: ENST00000558432
  CDS Start-End: 1-2436
attcccttcctctccaatctgccttcagagcgtggagctgcccgtttgtcccctcactgccttctctctttccccaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatc

SEQ ID NO: 174189 - DNA, 792 bp, Homo sapiens
  Payload ID: 14192
  Gene Symbol: RASGRP1
  Gene Name: RAS guanyl releasing protein 1 (calcium and DAG-regulated)
  ENST ID: ENST00000557875
  CDS Start-End: 1-372
gagaccacctacctgaagcccactttttgtgacaactgtgctggatttctctggggagtgatcaaacaaggatatcgatgtaaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataa

SEQ ID NO: 174190 - DNA, 547 bp, Homo sapiens
  Payload ID: 14192
  Gene Symbol: RASGRP1
  Gene Name: RAS guanyl releasing protein 1 (calcium and DAG-regulated)
  ENST ID: ENST00000558418
  CDS Start-End: 260-547
ttccccttcaggaagtgggagacagtaggacagagcaatcctaatgccaggatgaagagcactagttgcaaccctgaaatctcacctttgctggggagatgtctctttaacagccaaccagtcatttggtgcatttgccaagtgggaggggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgcc

SEQ ID NO: 174191 - DNA, 548 bp, Homo sapiens
  Payload ID: 14192
  Gene Symbol: RASGRP1
  Gene Name: RAS guanyl releasing protein 1 (calcium and DAG-regulated)
  ENST ID: ENST00000561117
  CDS Start-End: 377-548
tatacaggagaggccctggaggggagaaggcgtcctcactgcagtgctccgagcagcggccgcaggaagaggcgtggaagctgcgggtcggctgcgggaaagggggtcccatgggagccgctaggcgcagcccgtttcccgagctgaggtggaggtcgacgggcacaggtgccctgcaaggcgcgggcgtggtagccgggagcccgctcctctccaactcccctgagacttaaccctttggccaagagaggtcgaaggcgggcaggggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaag

SEQ ID NO: 174192 - DNA, 843 bp, Homo sapiens
  Payload ID: 14192
  Gene Symbol: RASGRP1
  Gene Name: RAS guanyl releasing protein 1 (calcium and DAG-regulated)
  ENST ID: ENST00000560425
  CDS Start-End: 1-654
cagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggcccatggaagtaatcatgaggtagcacataccatattaccactgaggataaaaagaaagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaa

SEQ ID NO: 174193 - DNA, 1757 bp, Homo sapiens
  Payload ID: 14192
  Gene Symbol: RASGRP1
  Gene Name: RAS guanyl releasing protein 1 (calcium and DAG-regulated)
  Uniprot ID: O95267
  ENST ID: ENST00000558164
  CDS Start-End: 8-1648
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 174194 - DNA, 2310 bp, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENST ID: ENST00000354024
  CDS Start-End: 254-2083
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 174195 - DNA, 429 bp, Homo sapiens
  Payload ID: 14193
  Gene Symbol: RASGRP2
  Gene Name: RAS guanyl releasing protein 2 (calcium and DAG-regulated)
  ENST ID: ENST00000377485
  CDS Start-End: 137-429
gctgccgcagggaccgccgcgtgcggggcgagagggagcccccggtgggggtggcgcagccggcggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctga

SEQ ID NO: 174196 - DNA, 667 bp, Homo sapiens
  Payload ID: 14193
  Gene Symbol: RASGRP2
  Gene Name: RAS guanyl releasing protein 2 (calcium and DAG-regulated)
  ENST ID: ENST00000377486
  CDS Start-End: 215-661
ggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 174197 - DNA, 642 bp, Homo sapiens
  Payload ID: 14193
  Gene Symbol: RASGRP2
  Gene Name: RAS guanyl releasing protein 2 (calcium and DAG-regulated)
  ENST ID: ENST00000377487
  CDS Start-End: 190-636
gcggggccgcggcgtggagagcgggcgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 174198 - DNA, 583 bp, Homo sapiens
  Payload ID: 14193
  Gene Symbol: RASGRP2
  Gene Name: RAS guanyl releasing protein 2 (calcium and DAG-regulated)
  ENST ID: ENST00000377489
  CDS Start-End: 131-577
gccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 174199 - DNA, 2983 bp, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENST ID: ENST00000377494
  CDS Start-End: 924-2756
gttgctaatggtgtcatgcacccaccggccacccttggcgcgagcgcccccctctggacaccctgctccgtgcgcgctcacagttcgcctgtgcggggccggggccagggtcaggagccggggatagggaggaagagggcctgtggacaagctgagccgggacccctgggacctttgcggaggtggcctgggagcgctcagttcccaggctcaggcttcccgctgacgcctcctggccgcagcgggctccccccgccccaggaatgttcctctcccatccagtccgcctcccctagggcaggccccctgggggctgccgcagccccgcctcgccttcctgggctcccgggagggggcgaggcgggcaggacgcctgggttctctccccccacctcccataccagggagaaattcctccgaggtcccctcaggctctgggttcccaaaataaccctgcgggggaagggaggctgtggagggagggaagcgggaggggcgcagagccgagctgcggggtgctgcaggtgcctctggggagagggcgcgaggagaaggcgccctgcggggggctgggcgccagccagtcctgggatcttggttcgtccccatcctcgtgaagcccctcggccttcccgcgactccgagggtgggccggaagcctctctgcgggtccgtttcccaactggcgggttgcaccatcccgggccagaccgtttaaccccgggagtggccgcgggggacaactccgcccctgtccagcagggggcgtgcccgccccgccccgtttctgcccgcggggccgctcccccgcccgcgactccgcagactcccgctctgcctctcccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagcagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 174200 - DNA, 2221 bp, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENST ID: ENST00000377497
  CDS Start-End: 165-1994
cgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 174201 - DNA, 444 bp, Homo sapiens
  Payload ID: 14193
  Gene Symbol: RASGRP2
  Gene Name: RAS guanyl releasing protein 2 (calcium and DAG-regulated)
  ENST ID: ENST00000394428
  CDS Start-End: 72-263
gggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 174202 - DNA, 453 bp, Homo sapiens
  Payload ID: 14193
  Gene Symbol: RASGRP2
  Gene Name: RAS guanyl releasing protein 2 (calcium and DAG-regulated)
  ENST ID: ENST00000394429
  CDS Start-End: 72-272
gggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgagttaagcggcctccttaaccctctccttcacctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 174203 - DNA, 2174 bp, Homo sapiens
  Payload ID: 14193
  Gene Symbol: RASGRP2
  Gene Name: RAS guanyl releasing protein 2 (calcium and DAG-regulated)
  ENST ID: ENST00000394430
  CDS Start-End: 1724-2170
agctaaggcgcgctggatccccggagggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggtatgtgtgcctgagggtttcttcgtgcaggtgtgcacagggtgtgggtgccattgtgtgtgagagacggaggatgggaggccggtgcctgtggcccggtgcgtgtaagtgcggacgcctgcacctccacttaggtccccggcctccgacgaataacttgggtgtggagtgtttgcccctgccagggtgcgtatgaccccgccagtgaccggagttgctaatggtgtcatgcacccaccggccacccttggcgcgagcgcccccctctggacaccctgctccgtgcgcgctcacagttcgcctgtgcggggccggggccagggtcaggagccggggatagggaggaagagggcctgtggacaagctgagccgggacccctgggacctttgcggaggtggcctgggagcgctcagttcccaggctcaggcttcccgctgacgcctcctggccgcagcgggctccccccgccccaggaatgttcctctcccatccagtccgcctcccctagggcaggccccctgggggctgccgcagccccgcctcgccttcctgggctcccgggagggggcgaggcgggcaggacgcctgggttctctccccccacctcccataccagggagaaattcctccgaggtcccctcaggctctgggttcccaaaataaccctgcgggggaagggaggctgtggagggagggaagcgggaggggcgcagagccgagctgcggggtgctgcaggtgcctctggggagagggcgcgaggagaaggcgccctgcggggggctgggcgccagccagtcctgggatcttggttcgtccccatcctcgtgaagcccctcggccttcccgcgactccgagggtgggccggaagcctctctgcgggtccgtttcccaactggcgggttgcaccatcccgggccagaccgtttaaccccgggagtggccgcgggggacaactccgcccctgtccagcagggggcgtgcccgccccgccccgtttctgcccgcggggccgctcccccgcccgcgactccgcagactcccgctctgcctctcccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactg

SEQ ID NO: 174204 - DNA, 2304 bp, Homo sapiens
  Payload ID: 14193
  Gene Symbol: RASGRP2
  Gene Name: RAS guanyl releasing protein 2 (calcium and DAG-regulated)
  Uniprot ID: Q7LDG7
  ENST ID: ENST00000394432
  CDS Start-End: 248-2077
gtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 174205 - DNA, 400 bp, Homo sapiens
  Payload ID: 14193
  Gene Symbol: RASGRP2
  Gene Name: RAS guanyl releasing protein 2 (calcium and DAG-regulated)
  ENST ID: ENST00000419843
  CDS Start-End: 360-400
gccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggggttcggtccgagcccggtgggaggctcccggagcgcagcctgggcccagcccaccccgcgccggcggccatggcaggcaccctggacctggacaagggctgcacggtgga

SEQ ID NO: 174206 - DNA, 956 bp, Homo sapiens
  Payload ID: 14193
  Gene Symbol: RASGRP2
  Gene Name: RAS guanyl releasing protein 2 (calcium and DAG-regulated)
  ENST ID: ENST00000445445
  CDS Start-End: 81-461
ccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgttagactgtgagctcctcgagggcaggaaccgtgtcttactcatctctgtattcccagcgcctagcacagtgcctggcacagaccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgt

SEQ ID NO: 174207 - DNA, 649 bp, Homo sapiens
  Payload ID: 14193
  Gene Symbol: RASGRP2
  Gene Name: RAS guanyl releasing protein 2 (calcium and DAG-regulated)
  ENST ID: ENST00000441258
  CDS Start-End: 162-539
gagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtactgtgagctcctcgagggcaggaaccgtgtcttactcatctctgtattcccagcgcctagcacagtgcctggcacagaccctacctacaagtggaagcggcaggtgactcagcgga

SEQ ID NO: 174208 - DNA, 935 bp, Homo sapiens
  Payload ID: 14193
  Gene Symbol: RASGRP2
  Gene Name: RAS guanyl releasing protein 2 (calcium and DAG-regulated)
  ENST ID: ENST00000431822
  CDS Start-End: 240-935
gtgaggatgtcagcgcctgtgtggccgcgggactcaaggctggcctggctcaagtgaacagcacgtccaggaggcgacctcgtccgcgggtttgcattctggggtggacgagctgggtccccggcctccgacgaataacttgggtgtggagtgtttgcccctgccagggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggag

SEQ ID NO: 174209 - DNA, 598 bp, Homo sapiens
  Payload ID: 14193
  Gene Symbol: RASGRP2
  Gene Name: RAS guanyl releasing protein 2 (calcium and DAG-regulated)
  ENST ID: ENST00000430645
  CDS Start-End: 348-598
ggcggggagcggggccgcggcgtggagagcgggcgggagccgcagccgcagcgaggccggcgggcgggagcgcacggaggtggggtcggccaggccggtgcgggctccttgcggcaggtcccaagaatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctc

SEQ ID NO: 174210 - DNA, 2168 bp, Homo sapiens
  Payload ID: 14193
  Gene Symbol: RASGRP2
  Gene Name: RAS guanyl releasing protein 2 (calcium and DAG-regulated)
  ENST ID: ENST00000421556
  CDS Start-End: 192-383
acgtgtgaggatgtcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 174211 - DNA, 4210 bp, Homo sapiens
  Payload ID: 14194
  Gene Symbol: RASGRP3
  Gene Name: RAS guanyl releasing protein 3 (calcium and DAG-regulated)
  Uniprot ID: Q8IV61
  ENST ID: ENST00000407811
  CDS Start-End: 273-2342
gataccctttacactagattagcaggcaaaactatgatggtttgtgatatccatgcttgtagaagtaataagaagaaagggaacacagaagctttattttatagtggagtcctgactctaggccttaataattgcatggttttggagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaagg

SEQ ID NO: 174212 - DNA, 4807 bp, Homo sapiens
  Payload ID: 14194
  Gene Symbol: RASGRP3
  Gene Name: RAS guanyl releasing protein 3 (calcium and DAG-regulated)
  Uniprot ID: Q8IV61
  ENST ID: ENST00000403687
  CDS Start-End: 741-2813
acagagcaacttccacctgctgtgcgagttggtgatcctctctcttgccgttcgagagccccagtgaaacttgagtgagatgagagagcatggagcctgccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgta

SEQ ID NO: 174213 - DNA, 4738 bp, Homo sapiens
  Payload ID: 14194
  Gene Symbol: RASGRP3
  Gene Name: RAS guanyl releasing protein 3 (calcium and DAG-regulated)
  Uniprot ID: Q8IV61
  ENST ID: ENST00000402538
  CDS Start-End: 653-2725
atttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactaactatgaactatttatttcctcctcccctacccctagttaagtgccacaaagactgtgttatgtagtcagtacttttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagacgtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattaca

SEQ ID NO: 174214 - DNA, 557 bp, Homo sapiens
  Payload ID: 14194
  Gene Symbol: RASGRP3
  Gene Name: RAS guanyl releasing protein 3 (calcium and DAG-regulated)
  ENST ID: ENST00000423159
  CDS Start-End: 218-557
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaac

SEQ ID NO: 174215 - DNA, 861 bp, Homo sapiens
  Payload ID: 14194
  Gene Symbol: RASGRP3
  Gene Name: RAS guanyl releasing protein 3 (calcium and DAG-regulated)
  ENST ID: ENST00000437184
  CDS Start-End: 346-861
gaaatagctgtctatcacaggcagctaggaactgcttgcccacttttttttgttctgaaagaaaggatacagaccatctgggccagttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctca

SEQ ID NO: 174216 - DNA, 554 bp, Homo sapiens
  Payload ID: 14194
  Gene Symbol: RASGRP3
  Gene Name: RAS guanyl releasing protein 3 (calcium and DAG-regulated)
  ENST ID: ENST00000444784
  CDS Start-End: 218-554
acttggcagctggacaggcagagtgctgatgtgaaaaataccacgacaaaaccaccctaatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaa

SEQ ID NO: 174217 - DNA, 540 bp, Homo sapiens
  Payload ID: 14194
  Gene Symbol: RASGRP3
  Gene Name: RAS guanyl releasing protein 3 (calcium and DAG-regulated)
  ENST ID: ENST00000425210
  CDS Start-End: 439-540
acttggcagctggacaggcagagtgctgatgtgaaaaataccacgacaaaaccaccctagtgttcatttcactgggcaggttgtctaccagaaccaaggggcctctttgaattttctttcaagctattaataagaggcatgcatcctcctagacacaatcatccatttagtaaaataggttctccaaaatacttatcattcaggttgaataaaccagttctacagactgcttcttccatgcatttcccaatgatgctagctgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttg

SEQ ID NO: 174218 - DNA, 596 bp, Homo sapiens
  Payload ID: 14194
  Gene Symbol: RASGRP3
  Gene Name: RAS guanyl releasing protein 3 (calcium and DAG-regulated)
  ENST ID: ENST00000442390
  CDS Start-End: 366-596
aacagctgctctcggcgtgctccggcacttggcagctggacaggcagagtgctgatgtgaaaaataccacgacaaaaccaccctaatggagtttcactctgtcgcccaggctggagtgcagtggcacgatctcggctcactgcaagctccgcctcccgggttcacaccattcttctgcctcagcctcccgagtagctgggactacagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttc

SEQ ID NO: 174219 - DNA, 548 bp, Homo sapiens
  Payload ID: 14194
  Gene Symbol: RASGRP3
  Gene Name: RAS guanyl releasing protein 3 (calcium and DAG-regulated)
  ENST ID: ENST00000419772
  CDS Start-End: 1-417
gccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcagcctgggagacagagtgagactccgtctgaa

SEQ ID NO: 174220 - DNA, 2926 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000293062
  CDS Start-End: 215-1945
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgg

SEQ ID NO: 174221 - DNA, 2941 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000433821
  CDS Start-End: 215-1960
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaagctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgg

SEQ ID NO: 174222 - DNA, 3116 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000454404
  CDS Start-End: 215-2134
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174223 - DNA, 2650 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000426920
  CDS Start-End: 215-1669
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgg

SEQ ID NO: 174224 - DNA, 2634 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000589358
  CDS Start-End: 215-2236
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174225 - DNA, 2293 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000587738
  CDS Start-End: 72-2093
gtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgc

SEQ ID NO: 174226 - DNA, 2592 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000589474
  CDS Start-End: 215-2194
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174227 - DNA, 3061 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000586305
  CDS Start-End: 97-2076
gctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 174228 - DNA, 3011 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000587753
  CDS Start-End: 215-2029
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174229 - DNA, 2942 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000614135
  CDS Start-End: 215-1960
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaagctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174230 - DNA, 3217 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000615439
  CDS Start-End: 215-2236
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgg

SEQ ID NO: 174231 - DNA, 2927 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000617966
  CDS Start-End: 215-1945
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174232 - DNA, 3313 bp, Homo sapiens
  Payload ID: 14195
  Gene Symbol: RASGRP4
  Gene Name: RAS guanyl releasing protein 4
  ENST ID: ENST00000618320
  CDS Start-End: 215-2068
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174233 - DNA, 2651 bp, Homo sapiens
  Payload ID: 14195
  Gene Symbol: RASGRP4
  Gene Name: RAS guanyl releasing protein 4
  Uniprot ID: Q8TDF6
  ENST ID: ENST00000622174
  CDS Start-End: 215-1669
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 174234 - DNA, 2075 bp, Homo sapiens
  Payload ID: 14196
  Gene Symbol: RHEB
  Gene Name: Ras homolog enriched in brain
  Uniprot ID: Q15382
  ENST ID: ENST00000262187
  CDS Start-End: 414-968
ggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgca

SEQ ID NO: 174235 - DNA, 501 bp, Homo sapiens
  Payload ID: 14196
  Gene Symbol: RHEB
  Gene Name: Ras homolog enriched in brain
  ENST ID: ENST00000470370
  CDS Start-End: 443-501
atggaggggttcaaagtcactaattgttcaaatatcaacatggaacctgggatccagcctttattggcagcctgaatccatgctcttgtctctgttctcttgatttcctcctctgcattttgaggagttgggaccgcgaggtgttctggctcttgggtgagccttccctagtcagtcaaggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatat

SEQ ID NO: 174236 - DNA, 1153 bp, Homo sapiens
  Payload ID: 14196
  Gene Symbol: RHEB
  Gene Name: Ras homolog enriched in brain
  ENST ID: ENST00000478470
  CDS Start-End: 341-484
ggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtgggttcctcaagccaggacctacgcacctgttgtgagtggtgttatagttctgcagggcgcacaggtgcatccccatgggcacatttaatttagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtc

SEQ ID NO: 174237 - DNA, 744 bp, Homo sapiens
  Payload ID: 14196
  Gene Symbol: RHEB
  Gene Name: Ras homolog enriched in brain
  ENST ID: ENST00000496004
  CDS Start-End: 487-726
accggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaagggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctga

SEQ ID NO: 174238 - DNA, 900 bp, Homo sapiens
  Payload ID: 14196
  Gene Symbol: RHEB
  Gene Name: Ras homolog enriched in brain
  ENST ID: ENST00000472642
  CDS Start-End: 416-655
ggccgccgaggagtccgggtctcgtctggggaagtgaggcggcgccggggagccgcgctagaggctgccgcgagggagtcacacctgcctccccgccttcgccgcgggcgcgcgtgaccggggctggcggtctcccccaccccgcccccgatggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgacc

SEQ ID NO: 174239 - DNA, 1210 bp, Homo sapiens
  Payload ID: 14197
  Gene Symbol: RHEBL1
  Gene Name: Ras homolog enriched in brain like 1
  Uniprot ID: Q8TAI7
  ENST ID: ENST00000301068
  CDS Start-End: 241-792
cggcgcggcgcggctcagtagttccccgggcgcccggctccctggcgttagacgtgctgtgttgtgatcacgtgggcagctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatacttacagcaagatagtgactcttggcaaagatgagtttcacctacatctggtggacacagcagggcaggatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatcttt

SEQ ID NO: 174240 - DNA, 1063 bp, Homo sapiens
  Payload ID: 14197
  Gene Symbol: RHEBL1
  Gene Name: Ras homolog enriched in brain like 1
  ENST ID: ENST00000420065
  CDS Start-End: 163-291
gctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatagatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaataaattgagaaatctt

SEQ ID NO: 174241 - DNA, 1261 bp, Homo sapiens
  Payload ID: 14197
  Gene Symbol: RHEBL1
  Gene Name: Ras homolog enriched in brain like 1
  Uniprot ID: Q8TAI7
  ENST ID: ENST00000550797
  CDS Start-End: 241-447
cggcgcggcgcggctcagtagttccccgggcgcccggctccctggcgttagacgtgctgtgttgtgatcacgtgggcagctccgggcgcggcgcttgttttggtttccttctaacttgcccacggcagcttcggggtgagcgactttcctgcaccagctgccgcgcctgctcacaccctgacctcgttttcgggctctctgagcccgcagttccgcaagcccctggggcgggctcctgccatgccgctagtccgctacaggaaggtggtcatcctcggataccgctgtgtagtccgaaaggacagaggatgtgaatgtggatggatgatttggatacaactgtcacactgctccccacagggaagacatctttggcacatcaatttgtggaaggcgagttctcggaaggctacgatcctacagtggagaatacttacagcaagatagtgactcttggcaaagatgagtttcacctacatctggtggacacagcagggcaggatgagtacagcattctgccctattcattcatcattggggtccatggttatgtgcttgtgtattctgtcacctctctgcatagcttccaagtcattgagagtctgtaccaaaagctacatgaaggccatgggaaaacccgggtgccagtggttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctagccctctgtttttgtttgatgaattctgttataacctatggggtcaggatatgagtcctgggcattatttatccaggacccatcctcttgggtgggttttgggtgttggctgggtaaggggagccggggacttctgaaatagagctggctccctggggtgacaatgtatatatgcaaa

SEQ ID NO: 174242 - DNA, 380 bp, Homo sapiens
  Payload ID: 14197
  Gene Symbol: RHEBL1
  Gene Name: Ras homolog enriched in brain like 1
  ENST ID: ENST00000550675
  CDS Start-End: 53-380
ttcgggctctctgagcccgcagttccgcaagcccctggggcgggctcctgccatgccgctagtccgctacaggaaggtggtcatcctcggataccgctgtgtagggaagacatctttggcacatcaatttgtggaaggcgagttctcggaaggctacgatcctacagtggagaatacttacagcaagatagtgactcttggcaaagatgagtttcacctacatctggtggacacagcagggcaggtaccagttggggatgagtacagcattctgccctattcattcatcattggggtccatggttatgtgcttgtgtattctgtcacctctctgcatagcttccaagtcattgagagtctgtaccaaaagctacatgaag

SEQ ID NO: 174243 - DNA, 889 bp, Homo sapiens
  Payload ID: 14198
  Gene Symbol: RHOA
  Gene Name: ras homolog family member A
  ENST ID: ENST00000454011
  CDS Start-End: 112-384
tcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaat

SEQ ID NO: 174244 - DNA, 2031 bp, Homo sapiens
  Payload ID: 14198
  Gene Symbol: RHOA
  Gene Name: ras homolog family member A
  Uniprot ID: P61586
  ENST ID: ENST00000418115
  CDS Start-End: 386-967
aatagcaaccaggtcttttatagccccggagttcccgtgatgccccacgcggctgcaatgattggttaagggttttgcttttagggcgtggacgggctcctgagcaatagtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaa

SEQ ID NO: 174245 - DNA, 633 bp, Homo sapiens
  Payload ID: 14198
  Gene Symbol: RHOA
  Gene Name: ras homolog family member A
  ENST ID: ENST00000445425
  CDS Start-End: 247-633
gcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagagatggtgtcttgctatgttgcccagacagatcttgtactcctgggctcaagttgtcctcctgcctcagcctcccaaagtgctgggattaaagatcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgg

SEQ ID NO: 174246 - DNA, 961 bp, Homo sapiens
  Payload ID: 14198
  Gene Symbol: RHOA
  Gene Name: ras homolog family member A
  ENST ID: ENST00000422781
  CDS Start-End: 154-717
tcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcattt

SEQ ID NO: 174247 - DNA, 2372 bp, Homo sapiens
  Payload ID: 14199
  Gene Symbol: RHOB
  Gene Name: ras homolog family member B
  Uniprot ID: P62745
  ENST ID: ENST00000272233
  CDS Start-End: 393-983
atctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttcgcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttataaaa

SEQ ID NO: 174248 - DNA, 2199 bp, Homo sapiens
  Payload ID: 14200
  Gene Symbol: RHOC
  Gene Name: ras homolog family member C
  Uniprot ID: P08134
  ENST ID: ENST00000285735
  CDS Start-End: 1211-1792
agtctgagcctccggcaccggccgcgcagctggaggcggcggagcggaaggtgtagggtgggccggcaaagtcaaccggccgctctggatcatctgggaattcaagagagcgattggagagaggtctgatgtagccacactgtcttgtcttggggaaggccccagaagttccaggctccattccaggccctgtgtggggctcagttgcccctcttaaggggtcagtgggacagtccctctggggctgcctctcacagggagttgtccatgccatcttggccttgggcctagtgtcctggcctgggctgcctgctgttctggcccaatcatagcctggagggaaagtcttctaattgggctggaggctccaggtcccttaacgcatgcctcaaccccgggtttctgtcctctgcctcccaccactctggtgccgtctgaattaccctgctggggggacagcagtggcatactcatgcctaagtgactggctttcaccccagtagtgattgccctccatcaacactgcccaccccaggttggggctaccccagcccatctttacaaaacagggcaaggtgaactaatggagtgggtggaggagttggaagaaatcccagcgtcagtcaccgggatagaattcccaaggaaccctctttttggaggatggtttccatttctggaggcgatctgccgacagggtgaatgccttcttgcttgtcttctggggaatcagagagagtccgttttgtggtgggaagagtgtggctgtgtactttgaactcctgtaaattctctgactcatgtccacaaaaccaacagttttgtgaatgtgtctggaggcaagggaagggccactcaggatctatgttgaagggaagaggcctggggctggagtattcgcttcctaaagggcagtgtgaggtggtggtggggtgtggggagtagaggcgttcagtcagcccagtttgacaggatgtgggactgagagaaaaagctaggtttgaggctgagatcaggttaccgtcgctttcttaactgctccctgcctggttggtgctgggactggccctcatttgtctcttcttttggggctcctcccagcccagactctagccccctcccccttcccaacagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctcc

SEQ ID NO: 174249 - DNA, 1418 bp, Homo sapiens
  Payload ID: 14200
  Gene Symbol: RHOC
  Gene Name: ras homolog family member C
  Uniprot ID: P08134
  ENST ID: ENST00000339083
  CDS Start-End: 403-984
attgaaggctgggcagagtctgagtccacccgggtcgtgctccccccgctcgcccggctcctccgcagtccaggaatctccccgtggctctccccgacctggaggggtggacgcccctggcccccagtccccggcctgcggagggggccggtggctgcggccctgcgcggggccggggcgggccgagccaagggccgcccccggccgaccctccccctgccgggcccgccctccccgccgcggcgctggaggagggcggggcggggccctggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtgtgtggcagctttcggtctttc

SEQ ID NO: 174250 - DNA, 1026 bp, Homo sapiens
  Payload ID: 14200
  Gene Symbol: RHOC
  Gene Name: ras homolog family member C
  Uniprot ID: P08134
  ENST ID: ENST00000369632
  CDS Start-End: 425-1006
aggtaccctgggccggggctgcgggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgaggtccgagtcggagccccttcccttctcctcccagcttcccggaacctgccccgccgggcgaggggcgagggaacttcaactcagacgccccagcccccaggccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttccta

SEQ ID NO: 174251 - DNA, 1295 bp, Homo sapiens
  Payload ID: 14200
  Gene Symbol: RHOC
  Gene Name: ras homolog family member C
  Uniprot ID: P08134
  ENST ID: ENST00000369633
  CDS Start-End: 301-882
ggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaacgtg

SEQ ID NO: 174252 - DNA, 786 bp, Homo sapiens
  Payload ID: 14200
  Gene Symbol: RHOC
  Gene Name: ras homolog family member C
  ENST ID: ENST00000369636
  CDS Start-End: 51-650
gcctccggcaccggccgcgcagctggaggcggcggagcggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcaggg

SEQ ID NO: 174253 - DNA, 888 bp, Homo sapiens
  Payload ID: 14200
  Gene Symbol: RHOC
  Gene Name: ras homolog family member C
  Uniprot ID: P08134
  ENST ID: ENST00000369637
  CDS Start-End: 80-661
tctgagcctccggcaccggccgcgcagctggaggcggcggagcggaagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatc

SEQ ID NO: 174254 - DNA, 1028 bp, Homo sapiens
  Payload ID: 14200
  Gene Symbol: RHOC
  Gene Name: ras homolog family member C
  Uniprot ID: P08134
  ENST ID: ENST00000369638
  CDS Start-End: 182-763
ctggggtcagtctgagcctccggcaccggccgcgcagctggaggcggcggagcggaagccttgacttcatctcagctccagagcccgccctctcttcctgcagcctgggaacttcagccggctggaggtcagttcccctccccagggaaggaggaagtgagggaagctgcgaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacac

SEQ ID NO: 174255 - DNA, 1355 bp, Homo sapiens
  Payload ID: 14200
  Gene Symbol: RHOC
  Gene Name: ras homolog family member C
  Uniprot ID: P08134
  ENST ID: ENST00000369642
  CDS Start-End: 365-946
aactttcccgacgccggtcctcccctaggggattgaaggctgggcagagtctgagtccacccgggtcgtgctccccccgctcgcccggctcctccgcagtccaggaatctccccgtggctctccccgacctggaggggtggacgcccctggcccccagtccccggcctgcggagggggccggtggctgcggccctgcgcggggccggggcgggccgagccaagggccgcccccggccgaccctccccctgccgggcccgccctccccgccgcggcgctggaggagggcggggcggggccctggggtcagtctgagcctccggcaccggccgcgcagctggaggcggcggagcggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaa

SEQ ID NO: 174256 - DNA, 866 bp, Homo sapiens
  Payload ID: 14200
  Gene Symbol: RHOC
  Gene Name: ras homolog family member C
  ENST ID: ENST00000425265
  CDS Start-End: 301-866
ggcggtggggcgtcttgggaactcgtccccaggagagcactttcccttcctcgctggcccggagatcggggcccgtgcgaggaggggcttcggcctgggcgtggaccccgttccctccaagcggagtcggcatccgggctgggcggtggtcggaccgcgtcggcccctccccgggctgcagcgagggggcccggacctgccggcaggggctctggcctcctgagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggagggg

SEQ ID NO: 174257 - DNA, 470 bp, Homo sapiens
  Payload ID: 14200
  Gene Symbol: RHOC
  Gene Name: ras homolog family member C
  ENST ID: ENST00000414971
  CDS Start-End: 196-470
aggaaggggctgttccagagtgggtggaggcatctgggtaccgaaggagataattcctgccaaaatgcccgacagagtgcctggcacctaggggctctataactattcttcctttacccacctaccacctggtagctggttctgctactctggtcctagagagggactcctcatttgtgactggacagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcct

SEQ ID NO: 174258 - DNA, 517 bp, Homo sapiens
  Payload ID: 14200
  Gene Symbol: RHOC
  Gene Name: ras homolog family member C
  ENST ID: ENST00000436685
  CDS Start-End: 135-517
gcagctggaggcggcggagcggaagcccagactctagccccctcccccttcccaacagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccag

SEQ ID NO: 174259 - DNA, 1042 bp, Homo sapiens
  Payload ID: 14200
  Gene Symbol: RHOC
  Gene Name: ras homolog family member C
  ENST ID: ENST00000468093
  CDS Start-End: 57-257
gcagctggaggcggcggagcggaagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcagactggctctgtaacctgggccgagtccctttgcctctgggtttaagctcccccacctgcaaaatggggatgatggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccattttcagttccctcctgcccaggactgcattgttttctagccccgaggtggtggcacgggccctccctcccagcgctctgggagccacgcctatgccctgcccttcctcagggcccctggggatcttgccccctttgaccttccccaaaggatggtcacacaccagcactttatacacttctggctcacaggaaagtgtctgcagtaggggacccagagtcccaggcc

SEQ ID NO: 174260 - DNA, 463 bp, Homo sapiens
  Payload ID: 14200
  Gene Symbol: RHOC
  Gene Name: ras homolog family member C
  ENST ID: ENST00000528831
  CDS Start-End: 90-290
gctggaggagggcggggcggggccctggggtcagtctgagcctccggcaccggccgcgcagctggaggcggcggagcggaagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcagactggctctgtaacctgggccgagtccctttgcctctgggtttaagctcccccacctgcaaaatggggatgatggtggagctggctctgtgggacacagcagggcaggaagactatgatcgactgcggcctctctcctacccggacactgatgtcatcctcatgtgcttctccatcgacagccctgacagcctggaaaacattcctgagaagtggacc

SEQ ID NO: 174261 - DNA, 891 bp, Homo sapiens
  Payload ID: 14200
  Gene Symbol: RHOC
  Gene Name: ras homolog family member C
  ENST ID: ENST00000484280
  CDS Start-End: 133-333
ggggtcagtctgagcctccggcaccggccgcgcagctggaggcggcggagcggaagccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcagactggctctgtaacctgggccgagtccctttgcctctgggtttaagctcccccacctgcaaaatggggatgatggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggaggtgtttgagatggccactcgggctggcctccaggtccgcaagaacaagcgtcggaggggctgtcccattctctgagatccccaaggcctttcctacatgccccctcccttcacaggggtacagaaattatccccctacaaccccagcctcctgagggctccatgctgaaggctcccat

SEQ ID NO: 174262 - DNA, 521 bp, Homo sapiens
  Payload ID: 14200
  Gene Symbol: RHOC
  Gene Name: ras homolog family member C
  ENST ID: ENST00000484054
  CDS Start-End: 134-521
ccggcaccggccgcgcagctggaggcggcggagcggaagggcaaggtgaactaatggagtgggtggaggagttggaagaaatcccagcgtcagtcaccgggatagaattcccaaggaaccctctttttggaggatggtttccatttctggaggcgatctgccgacaggccttgacttcatctcagctccagagcccgccctctcttcctgcagcctgggaacttcagccggctggagccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctgg

SEQ ID NO: 174263 - DNA, 574 bp, Homo sapiens
  Payload ID: 14200
  Gene Symbol: RHOC
  Gene Name: ras homolog family member C
  ENST ID: ENST00000534717
  CDS Start-End: 67-574
aagcccgggaagctgactccttgccctgagtcacagggaggggtgggcagggcatgcggccccaccatggctgcaatccgaaagaagctggtgatcgttggggatggtgcctgtgggaagacctgcctcctcatcgtcttcagcaaggatcagtttccggaggtctacgtccctactgtctttgagaactatattgcggacattgaggtggacggcaagcaggtggagctggctctgtgggacacagcagggcaggaagactatgatcgactgcggcctctctcctacccggacactgatgtcatcctcatgtgcttctccatcgacagccctgacagcctggaaaacattcctgagaagtggaccccagaggtgaagcacttctgccccaacgtgcccatcatcctggtggggaataagaaggacctgaggcaagacgagcacaccaggagagagctggccaagatgaagcaggagcccgttcggtctgaggaaggccgggacatggcgaaccggatcagtgcctttggctaccttgagtgctcagccaagaccaaggagggagtgcgggagg

SEQ ID NO: 174264 - DNA, 1129 bp, Homo sapiens
  Payload ID: 14201
  Gene Symbol: RHOD
  Gene Name: ras homolog family member D
  Uniprot ID: O00212
  ENST ID: ENST00000308831
  CDS Start-End: 86-718
attcctgccccgccgggcctgccccgcgcagtctgggtctctgcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatca

SEQ ID NO: 174265 - DNA, 538 bp, Homo sapiens
  Payload ID: 14201
  Gene Symbol: RHOD
  Gene Name: ras homolog family member D
  ENST ID: ENST00000532559
  CDS Start-End: 15-449
cgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtg

SEQ ID NO: 174266 - DNA, 3009 bp, Homo sapiens
  Payload ID: 14202
  Gene Symbol: RHOF
  Gene Name: ras homolog family member F (in filopodia)
  Uniprot ID: Q9HBH0
  ENST ID: ENST00000267205
  CDS Start-End: 630-1265
gtgcacgctggcgtccctggcccaggcgaggtgggcagacatgactctcgcgtcagcatcttccctggtgccaccgccgctacctcctgtggggaagctgaggccagaggcggacatgtgccaagccacaccgctggggcagtgcaaagttgaggggctcttcccggagctggaggccgggggcttctcgaacccggtgcggaggcacagccagccaatccgggagaccctgtctggccgcgccagccaatcagagggtccctgccgaaggcggagcctgctaatcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaa

SEQ ID NO: 174267 - DNA, 670 bp, Homo sapiens
  Payload ID: 14202
  Gene Symbol: RHOF
  Gene Name: ras homolog family member F (in filopodia)
  ENST ID: ENST00000535560
  CDS Start-End: 332-670
ggcgattgcccggcagagggcgtcagacgtccaccctgcagcccagggtcggggtgcgggtaagcggagcccagtccctcaccccgaacccgcgtgcacgctggcgtccctggcccaggcgagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaaggtg

SEQ ID NO: 174268 - DNA, 699 bp, Homo sapiens
  Payload ID: 14202
  Gene Symbol: RHOF
  Gene Name: ras homolog family member F (in filopodia)
  ENST ID: ENST00000537265
  CDS Start-End: 284-619
gagcccagcggggtgagggggggctgatccgggacgagtgaggggggtggacagtggattcagctggaactttggcccccgccggccccactaaggaccaacccgaccccctctcccgcagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccat

SEQ ID NO: 174269 - DNA, 1626 bp, Homo sapiens
  Payload ID: 14202
  Gene Symbol: RHOF
  Gene Name: ras homolog family member F (in filopodia)
  ENST ID: ENST00000541657
  CDS Start-End: 1536-1626
ggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggtaataagaacaaagacaccaccataacccccaaatttcccaactaaatcaaaaaatatatatgtttttacaataacgtctccaaaaccaccgcccagcttgatcttctagactccatggcaccgggctgagcgggttctgggccggagaaggggcgacgttcgggcaccccccgaatggacaatctttccttctgtcaacggcaggggcaggcctagtttgactctgacagtcctcccactaagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggct

SEQ ID NO: 174270 - DNA, 1219 bp, Homo sapiens
  Payload ID: 14202
  Gene Symbol: RHOF
  Gene Name: ras homolog family member F (in filopodia)
  ENST ID: ENST00000546227
  CDS Start-End: 994-1219
gcggccgccgcgcgccgggcgggaggagcggcaggggtagggggctgggcgacccggcggcccacgcgggcaccaggaggcctcgccccggaccgcttccctctttcgtctttgtcctgcgcgggcgcccgcagccgagggccacggggtcggcggggcttcgaggccgccccgggtcccaccggctcctccggaagccgcggaccggcctggccctgaccccaggccgccccccgctgcccacccagctctgggcgcccaggtccgacctcccagtcgccctctgagagccgagtcagcgcggggcggggggtcgccccctttgtcctcactcagggcgggaggccctcggggtggccgcagacgccccgttgggcagccctccagcccagctctccaggcaggaggtgggggaagcctgggaaagcggagggggggccccgggatcccccgaggcgcggggctcccggcgaagcctcagatctccggcccttcccggggagggtgcgggcggggcgggcctttggaaatgcagatgagccgccgcccgggccggggttgaaccttctgactcagccacccccggccgcccgggccgctgggggaggggcggcgtctggggtgctccctttcagccccggagcccgtctgctgtgtattcggccggtcacatctctctcccccaacgccctgatccgccctccaccttcctctcctccaggttctgggccggagaaggggcgacgttcgggcaccccccgaatggacaatctttccttctgtcaacggcaggggcaggcctagtttgactctgacagtcctcccactaagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgcca

SEQ ID NO: 174271 - DNA, 1485 bp, Homo sapiens
  Payload ID: 14202
  Gene Symbol: RHOF
  Gene Name: ras homolog family member F (in filopodia)
  Uniprot ID: Q9HBH0
  ENST ID: ENST00000537171
  CDS Start-End: 630-1142
gtgcacgctggcgtccctggcccaggcgaggtgggcagacatgactctcgcgtcagcatcttccctggtgccaccgccgctacctcctgtggggaagctgaggccagaggcggacatgtgccaagccacaccgctggggcagtgcaaagttgaggggctcttcccggagctggaggccgggggcttctcgaacccggtgcggaggcacagccagccaatccgggagaccctgtctggccgcgccagccaatcagagggtccctgccgaaggcggagcctgctaatcaggggcacctggagtcgctgggcagccacgatcgggtctcgccggcgaggggcgcgacgtgacgcgcggagggtggcggtgggttgggggtgggagctttgctcgcagctgagccccgtttttccggtgctgcagtatccctgggactgagagctgaatacccacacccagggctgagaccttagcagaaaggaaactgaggctgggaggtcggccgggaggctgcctggcggaggcggcgctgctccgagtgggcggggctggttccggccccgccccgcccccgacctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcaggtgggccggggccaagaccctggggcacagccgtggctgtgaagcctcccggacctttggcctctgcaactggggtgccttagtggcctttcagggagctgagggaagcaagattctaagaataatttttaactattagtattgatggcctgtggacctgagcactttacacgactactcccaatccttaggactcggaggcaggcgctgttcacatcccccagtttacagggggagaaactgaggcccagagaggttaagcagcttgcccagggccacacagctagcgagaagtggagccaggatctggtcccatccactgcaatccaaagtctgtgctatgagccgccgtcctgtcgtgtcctgtctgccttgtttgaaagta

SEQ ID NO: 174272 - DNA, 1319 bp, Homo sapiens
  Payload ID: 14203
  Gene Symbol: RHOG
  Gene Name: ras homolog family member G
  Uniprot ID: P84095
  ENST ID: ENST00000351018
  CDS Start-End: 159-734
cacttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 174273 - DNA, 1066 bp, Homo sapiens
  Payload ID: 14203
  Gene Symbol: RHOG
  Gene Name: ras homolog family member G
  Uniprot ID: P84095
  ENST ID: ENST00000396978
  CDS Start-End: 344-919
ccggcccaggactcggcgcgggcgccggctcatgagtttgctggcggaggccgcgggcgggagcttctcggttcagtccaagtagggcgggcgcggccggccgggcggggcgggaacggggccactgcgagccggcggaggctcggcgagggtggcttcccggcggctgtaccgcctctagggagccgagagggacccctgaggtcggagggtcccgggctccaagataagtgtctctgaagtggaagagctcagagctgggagatcggacgcaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttt

SEQ ID NO: 174274 - DNA, 1289 bp, Homo sapiens
  Payload ID: 14203
  Gene Symbol: RHOG
  Gene Name: ras homolog family member G
  Uniprot ID: P84095
  ENST ID: ENST00000396979
  CDS Start-End: 133-708
catgaatgcaccaggatgggctaggcatgagagcctgggaacttggaagcaaaaaggctcagatgtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctcc

SEQ ID NO: 174275 - DNA, 886 bp, Homo sapiens
  Payload ID: 14203
  Gene Symbol: RHOG
  Gene Name: ras homolog family member G
  Uniprot ID: P84095
  ENST ID: ENST00000533217
  CDS Start-End: 193-768
cagggtcttgctctgtcgcacaggctggagtgcagtggtgtgatcatagcccactgcagccttgaccaccctgggatcaagtgatgctcccacctcagcctcccgagtagctgggactacaggtgtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttcc

SEQ ID NO: 174276 - DNA, 4305 bp, Homo sapiens
  Payload ID: 14204
  Gene Symbol: RHOH
  Gene Name: ras homolog family member H
  Uniprot ID: Q15669
  ENST ID: ENST00000381799
  CDS Start-End: 725-1300
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctccaagcaatggcaacagaacttggaacagaagcaagagagtgtcactttcacttctggtagggtggttcccaggcgactgcaggtcctgtgaaagacaggggtctcaaagttctgttaatttcacaaatttgttataaatttgtctaaactgagctgttgtggcaacataatttatgaatcgtaaggtctagttaggcttattggggggatatctacatatatatgtgtatgtaagggaaaaaaggtagaatttacagccttcaaaaaagaaaaatcaaattccaagcacaggaataagaaagctatatagcaactgctcagagaacagaaagttatcaggggaaatactgaataaatagacacacacatactcgcacacaacctgctctcacacacacaactcaaacctcattctatcgaatagtttaaaagcaatggtgttgctcatctgttaaagtggagaacagaggactacataacttaaggtagaaattgcaaaggctgggttgggcagggcgtggtggctcactttgggaggctgagacgggtggatcacgaggccaggagttcaagaccagcctggccaacatggtgaaaccccgtctcttctaaatattagctaaaaattagctgggtgtggtggcacatgcctgtagttctagctactcaagaggctgaggcaaaagaattgctcgaacctgggaggcggaggttgcagtaagccaagatcgcgccactgcactccagcctgggcaacagagggagactccatctcaaaaaaaaaaaaaagaaaagaaaaaaaagaaagaaattgcaaaggctggcacctagatagatcaatcaattactgccctaatcaaaacttagaaacactctgaaccacctttatgaaggtacatcattgttatggggtaacgtgactattacacacaaaaggtaaggtggctggcataaatgactttgattagaattatgttgacatagccaaaccagtttctctgttcccttgtgtggtcaattccttacagctataatcagtatcaaaaaccaaatgtgtgctcattcacacattgctttctccttctctctctcctcctatccacagccagtaaaaggcctgggaccggggtcttgatctctggtgggaggattgcctcggttccctggggctgacacagctgccttcactcagacttctctgctctccaggcggtggcttgtactcacctctaagtcacccgcctcccttgattggagagcccgtgtctctagttctcagctcagggttggggggcttgaaagatgaccgggcaggggaggggaagggatctcatatcctctgatatccctgggattctcttcttctccctcaacccacagagtcttaaatcacggatgcgggtgttcagggccagcctttgccatgagaggtatttaacatgtcagtgggaaggaatttctattcactgcagtgggctgtcccccaggcttttctttctctcttgttgaagagagatgggggtgggtatctgaaagtgggaagggccaccatacatgatcctaagtgaaggaagaggaggtggttccacggtggcagcagagcaggaagggaaggccagagagggcacactcaaatggctttgctgtcacctgggcaaagacacacaggtgagacctccacctgttggcgggagccaagcttaacagctccgtctgggaactctcatacctgagaccaggaatctatgtgtaaaccctttccagtggcagaatctggcagaaatggagccgataagtgtctgtcttcctgctagactgctgttcttgaaggtagcactgcctcctggtctcctcagtgtccccagggctcagcacagggaaggcaatggaggtaaagttgtgttaaactgaaatggagagaaagacagtaattgggcttctgtgccacacagtggttatagaaagcaagcagaccctcaccagccttgtaggggtaagaagaaaaataggtcatatgggtagaatccgtgtgttgtgtgttctacataagcacatacttacttttgcctgcctagatgcagacacaggtttcttatacttcaaaatttgtggtacctttttgtagactattgcatatcgattcttaactattccaagtagcagcattaaatatgttcttgatgacattaaagagttaattttca

SEQ ID NO: 174277 - DNA, 571 bp, Homo sapiens
  Payload ID: 14204
  Gene Symbol: RHOH
  Gene Name: ras homolog family member H
  ENST ID: ENST00000511121
  CDS Start-End: 553-571
actgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaacctttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagt

SEQ ID NO: 174278 - DNA, 874 bp, Homo sapiens
  Payload ID: 14204
  Gene Symbol: RHOH
  Gene Name: ras homolog family member H
  ENST ID: ENST00000508513
  CDS Start-End: 827-874
tgtgaggctgtgagatgggagaatcaatctatttattggtcagaaagtggttgttcagtaccttggatttctgagtgggcaaggctggaccctgagccctgggacctctgaagtgaacactgcagggccatttgttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtgggg

SEQ ID NO: 174279 - DNA, 814 bp, Homo sapiens
  Payload ID: 14204
  Gene Symbol: RHOH
  Gene Name: ras homolog family member H
  ENST ID: ENST00000507851
  CDS Start-End: 488-814
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacc

SEQ ID NO: 174280 - DNA, 1225 bp, Homo sapiens
  Payload ID: 14204
  Gene Symbol: RHOH
  Gene Name: ras homolog family member H
  Uniprot ID: Q15669
  ENST ID: ENST00000505618
  CDS Start-End: 617-1192
agtttgagaagaagcagtgatcaccttcttcttcactcttcacgctgatgaatttctacatcactgtgcatgtcctgtgctttgcagtcattccctaggagctcgggcccttgacccaaagatactgctcttactaacactacattttaaactcctcctctggactcactctcagagcctgccgcacaatctttaaaaactttgtcaatgattgcaaaatctttttccttttagagtggatttgattttaggagacagccattcggagctacatccagtgaataagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatg

SEQ ID NO: 174281 - DNA, 789 bp, Homo sapiens
  Payload ID: 14204
  Gene Symbol: RHOH
  Gene Name: ras homolog family member H
  ENST ID: ENST00000503941
  CDS Start-End: 481-789
agaggcgtgtaggtcaggagcaggaggaagcccaacgctggactgtaccagatcatctaaaactggcaattccaggcacagaaaaccagttcttcagaagcagaagggtggtcagccagggggtgaaagggacaggggtctcgcagccagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattagg

SEQ ID NO: 174282 - DNA, 2114 bp, Homo sapiens
  Payload ID: 14204
  Gene Symbol: RHOH
  Gene Name: ras homolog family member H
  Uniprot ID: Q15669
  ENST ID: ENST00000614836
  CDS Start-End: 737-1312
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccaggttgctactgagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174283 - DNA, 2268 bp, Homo sapiens
  Payload ID: 14204
  Gene Symbol: RHOH
  Gene Name: ras homolog family member H
  Uniprot ID: Q15669
  ENST ID: ENST00000610353
  CDS Start-End: 891-1466
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174284 - DNA, 2156 bp, Homo sapiens
  Payload ID: 14204
  Gene Symbol: RHOH
  Gene Name: ras homolog family member H
  Uniprot ID: Q15669
  ENST ID: ENST00000615083
  CDS Start-End: 779-1354
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacaggtggggatttaggaaccaagaatccagaactctcctaccagggccccagaaacctttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174285 - DNA, 1865 bp, Homo sapiens
  Payload ID: 14204
  Gene Symbol: RHOH
  Gene Name: ras homolog family member H
  Uniprot ID: Q15669
  ENST ID: ENST00000613272
  CDS Start-End: 488-1063
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174286 - DNA, 2227 bp, Homo sapiens
  Payload ID: 14204
  Gene Symbol: RHOH
  Gene Name: ras homolog family member H
  Uniprot ID: Q15669
  ENST ID: ENST00000615577
  CDS Start-End: 850-1425
aagtgtttaccataaagggcagctgtgaggctgtgagatgggagaatcaatctatttattggtcagaaagtggttgttcagtaccttggatttctgagtgggcaaggctggaccctgagccctgggacctctgaagtgaacactgcagggccatttgttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174287 - DNA, 2230 bp, Homo sapiens
  Payload ID: 14204
  Gene Symbol: RHOH
  Gene Name: ras homolog family member H
  Uniprot ID: Q15669
  ENST ID: ENST00000619474
  CDS Start-End: 853-1428
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagggatatttgcatttcaacaaagtaccaaacctcaagagaaagggctgctccaaggatggaagatatatttggtagggagaggactttttatcacccttgattcactccatgtaagcagggaccttctgtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174288 - DNA, 2254 bp, Homo sapiens
  Payload ID: 14204
  Gene Symbol: RHOH
  Gene Name: ras homolog family member H
  Uniprot ID: Q15669
  ENST ID: ENST00000622175
  CDS Start-End: 877-1452
tattctaatggagagaaacgcacgtgcacacacacccccctaaacccacacaaatgaaaccccctctgcggagaagccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagcacgaggatgctttggagaacggaaggatttcatcgagtccaaaggacactcacctctaggcctctcagcctccttggccacgtggttgttctgctactgagagtctgcagatgagctggtggtttctccaagcttccgagagctctctcagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174289 - DNA, 1872 bp, Homo sapiens
  Payload ID: 14204
  Gene Symbol: RHOH
  Gene Name: ras homolog family member H
  Uniprot ID: Q15669
  ENST ID: ENST00000617441
  CDS Start-End: 495-1070
actgtgtgaagattagaggcgtgtaggtcaggagcaggaggaagcccaacgctggactgtaccagatcatctaaaactggcaattccaggcacagaaaaccagttcttcagaagcagaagggtggtcagccagggggtgaaagggacaggggtctcgcagccagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataattttggacgatgaagtgagtttttcaaagaattccatatttaaagacacattttatttaactaataacaaaatgtattgcttttgtatatatttagttttcacacttggaaaatcttttcctacatcctcgaaaacataaactcctctgtgagtgaaatgcttgtacgaagctctgccatatgtttgtagtgttattattttcacctcaagtagaaagtctgttgaaaccacttggctgctggatttaaatgggtaatcaaatttaaaaatgaccataaatgaatctttgcaatttgttttctacttacctgttattcacagttggatataaaatacagttccataagatatcctaatactgcctaatgattttaaagttatcactatatttttctgaaatgataaaacatcattcatttatttactatattgtctttcactcaactccagttatgcactaaatattctcctctcattcaccaagattgattgaaacaccatctttcaggtagagaatcagactgctcc

SEQ ID NO: 174290 - DNA, 3302 bp, Homo sapiens
  Payload ID: 14205
  Gene Symbol: RHOJ
  Gene Name: ras homolog family member J
  Uniprot ID: Q9H4E5
  ENST ID: ENST00000316754
  CDS Start-End: 463-1107
cggcaagctggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcgatcggagcacagtgctacttggaatgttcagctctgactcagaaaggtctcaaagcggtttttgatgaagcaatcctcaccattttccaccccaagaaaaagaagaaacgctgttctgagggtcacagctgctgttcaattatctgaggttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaatgtactaatttccagttcactcaggccttactaatccataccaaattagcctaaagacaaggcattttatattcatttctattttcagcatgtttctaccaaagctattagaaccaacacgtacctctgaatgcccgattataagaagacatgagaagactttaaaagttttggaaatttacagagccatgatttttgaacctaattgaaagaaaaccatctgaattgttgcaggtccacatttttgccaaagatacactctatagatgcttagtagtggcctgatttttttccatgtattgccacgacaaactaaaaatgaactgtgtttaagaatgtagtatttctgtttttcatccaagttgattgggggaagaatatggcaggatccatcttttacagtattttgtattcagtaaagtggacattcctgctcctcccttcccccattgcatgccctcttcctcccttgatttcactttctctcatgcccggatccttttattctccccagttataacccagttataaaagaaagatctgagcataaagatacgtgtttaaaaataactaaaagtaaaggaaagtgccttaatttttctatttgcttcaactgaaagtgcttctcagctcgccccatgtaagttctcattccatgtaaatgacattttccagttacaactggtactgagattttgcctctctctttccttactcatcctcccaaatgtctttgtgggagccatatcagtggataccaagctctgtatccatttgtcccctgccctccacaatgtgtgacatagaacagggactttggccctgggaaagcaaaagctcccagtaaggaatcctgtgcccaatgatgtaaaacaattccaaacatccaggaatttttgtatcatagagcgaattacttcctatcttttcattagaggctatgaggacttctaattagtcttagttgcttataagtgccctggaatcacccaggtaggcacttaatttttttttcagttgcatgagcaaagtgcttcttagtagtgtgaaattacaacaactttaagactttccagattcaagctcccactgttggaaaaagccagcctttctaatctcttctgctactggaataagcacttaagaattgcgtgatagccaggcaccgtggctcatgcctgtaatcccaacacttagggaggctgaggtgggtgggccgcttgagctcaggagttcaagaccagcctgggtaatatagtgagatcctgtgtctctataaaaaaattaaaaattagtcagttgtagtgacacatacctgtagtcccagctactcaggaggctgaggtggaaggatcacttgagcccagaaggtaaggctgcagtgagctgtgactgtgccactacactccagcctgagtgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggca

SEQ ID NO: 174291 - DNA, 548 bp, Homo sapiens
  Payload ID: 14205
  Gene Symbol: RHOJ
  Gene Name: ras homolog family member J
  ENST ID: ENST00000555125
  CDS Start-End: 12-548
gagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgtcgtaaaccctgcctcttaccacaatgtccaggaggaatgggtccccgagctcaaggactgcatgcctcacgtgccttatgtcctcatagggacccagattgatctccgtgatgacccaaaaaccttggcccgtttgctgtatatgaaagagaaacctctcacttacgagcatggtgtgaagctcgcaaaagcggtacagtcagatttgaatttcattttaaatgtatgctga

SEQ ID NO: 174292 - DNA, 1837 bp, Homo sapiens
  Payload ID: 14205
  Gene Symbol: RHOJ
  Gene Name: ras homolog family member J
  ENST ID: ENST00000557447
  CDS Start-End: 757-1218
gctcgctctaaccattccccctgcttctgtggcaggcagtaatccccgctttccatcctctagtcagcttcttcccagccagccacaagcgaacaggctcgcaagcagcggatgaaacaggaagtctgacagcttgagtctgcagtgggacccctagtgttttcccactccatgtcctggcatcgttccccagaagtacaaacacacacacacagagctcccattgttgcagccttcctcagcccactgatcctaatatggaattcagcaggaaacccatgatttcctgacactcggcaagctggaggaagcaaagggaaaaaaactccattaaaaagcccagctttcctccatgttagatgtgacttggaaaatgagaaagatttagcaaaattccaccgtatcttttgccaggctagagacagggagagcagagtaaaaccctcaggctgctgaaatttctaggctgttaggaagcccctcgaattctgtgaaaatgagggtttcttaactcacactgagagcggaaaggggcagacccttttcataactccctcaagtgtgtgttacctttctttaccagcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagaatgaactgcaaagagggaactgacagcagctgcggctgcaggggcaacgacgagaagaagatgttgaagtgtgtggtggtgggggacggtgccgtggggaaaacctgcctgctgatgagctacgccaacgacgccttcccagaggaatacgtgcccactgtgtttgaccactatgcagttactgtgactgtgggaggcaagcaacacttgctcggactgtatgacaccgcgggacaggaggactacaaccagctgaggccactctcctaccccaacacggatgtgtttttgatctgcttctctgttgtctgggacctgcctccaccccatccagggatgagaatggcagccaatctctgtggccaagctccagccaaaaaggagggcacgaccagaaaggaactccctttgcacggaggcttgccccatcaccctctgagccctcccaacacagcacactagtcagcccactgccacgacctccctgccagccagaagcatccgtactgcacgctgtctgagaatgctgggcctggattgcagacagtgccgctgctgatcgcatcaaaaacaaagtcaaaggccatctcacattttacaaatccccagctcatgaacgtgaagctgataggaaatcaccccagggaacccgaaaaagaaacttgattcctctattgctggccttacttgatgtcttttataaaacttgggactacaatactaacctttttttctgaatctgctgttctacccatgtgtctcacattcatttgtattatttcaagaaattgacagagaaagaacctgtcaaaaaaaaaaaaaaaacaacctacatttcaagtactatttcccttctctcccatctaattgctaaagattttctttcatacgcacacactccagtgactggaaaaacgggagttttcagtcaaagcttgacatttagagaaaacaaggactttctgcctttataaatggaaatcaactgtgtatgaactataactctgcagaggttatgaattcatcctttacaaacaataatgaacttttagtcctgtaataaatgaaatgttattaggca

SEQ ID NO: 174293 - DNA, 2975 bp, Homo sapiens
  Payload ID: 14206
  Gene Symbol: RHOQ
  Gene Name: ras homolog family member Q
  Uniprot ID: P17081
  ENST ID: ENST00000238738
  CDS Start-End: 320-937
ccggtcttatgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 174294 - DNA, 714 bp, Homo sapiens
  Payload ID: 14206
  Gene Symbol: RHOQ
  Gene Name: ras homolog family member Q
  ENST ID: ENST00000432183
  CDS Start-End: 312-464
atgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagag

SEQ ID NO: 174295 - DNA, 674 bp, Homo sapiens
  Payload ID: 14206
  Gene Symbol: RHOQ
  Gene Name: ras homolog family member Q
  ENST ID: ENST00000482449
  CDS Start-End: 450-674
ggctcctgctccccgcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagag

SEQ ID NO: 174296 - DNA, 869 bp, Homo sapiens
  Payload ID: 14206
  Gene Symbol: RHOQ
  Gene Name: ras homolog family member Q
  ENST ID: ENST00000489471
  CDS Start-End: 1-276
ccggaggagtacgtgcccaccgtcttcgaccactacgcagtcagcgtcaccgtggggggcaagcagtacctcctaggactctatgacacggccggacaggctttgcagcaaagcgagttggatttctgggaggagatttctgtttcatctggatcctggggtcacgtgatcacgttttccttccatacgagagcatgggtttccagtggccaggatctgttgtgtccactagctccagcatccgctgtcttactgttggacagaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagc

SEQ ID NO: 174297 - DNA, 757 bp, Homo sapiens
  Payload ID: 14206
  Gene Symbol: RHOQ
  Gene Name: ras homolog family member Q
  ENST ID: ENST00000473428
  CDS Start-End: 1-103
ggggggcaagcagtacctcctaggactctatgacacggccggacaggaggacactggagagttggctgtgagaagttgtgactttgataagtcgatcttttaaaagaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggta

SEQ ID NO: 174298 - DNA, 642 bp, Homo sapiens
  Payload ID: 14206
  Gene Symbol: RHOQ
  Gene Name: ras homolog family member Q
  ENST ID: ENST00000616091
  CDS Start-End: 1-642
atgcccggagccggccggagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtga

SEQ ID NO: 174299 - DNA, 3133 bp, Homo sapiens
  Payload ID: 14207
  Gene Symbol: RHOT1
  Gene Name: ras homolog family member T1
  Uniprot ID: Q8IXI2
  ENST ID: ENST00000333942
  CDS Start-End: 240-2096
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtgatcttgagttcttttgtcatctaaagtaaatatttctgtacaga

SEQ ID NO: 174300 - DNA, 2919 bp, Homo sapiens
  Payload ID: 14207
  Gene Symbol: RHOT1
  Gene Name: ras homolog family member T1
  ENST ID: ENST00000354266
  CDS Start-End: 193-1986
gcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaa

SEQ ID NO: 174301 - DNA, 3297 bp, Homo sapiens
  Payload ID: 14207
  Gene Symbol: RHOT1
  Gene Name: ras homolog family member T1
  Uniprot ID: Q8IXI2
  ENST ID: ENST00000358365
  CDS Start-End: 228-2303
gccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 174302 - DNA, 2960 bp, Homo sapiens
  Payload ID: 14207
  Gene Symbol: RHOT1
  Gene Name: ras homolog family member T1
  Uniprot ID: Q8IXI2
  ENST ID: ENST00000394692
  CDS Start-End: 14-1966
gagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 174303 - DNA, 2516 bp, Homo sapiens
  Payload ID: 14207
  Gene Symbol: RHOT1
  Gene Name: ras homolog family member T1
  Uniprot ID: Q8IXI2
  ENST ID: ENST00000545287
  CDS Start-End: 157-2136
tgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgt

SEQ ID NO: 174304 - DNA, 421 bp, Homo sapiens
  Payload ID: 14207
  Gene Symbol: RHOT1
  Gene Name: ras homolog family member T1
  ENST ID: ENST00000584852
  CDS Start-End: 1-174
atgtatccccatgcccggttacgctgtatgtgcacctgcaacaggtgtacattttgcatctgtcagaacttcctcaactcagacttgctgcaatctgtaaagaacaaaatcttcactgcagttcttaacaggcatgaaaacagccctggaagtctgccctggcgcctgcactgagactaatccaggtcactttagggaaactgcccagctctggcaccgcactgtgtgtctgtcagctctgtggggtgctatggcctcattttcccactagaggacactgtggctccaggacttcatgtggcgcccagccagtcttgctactccagcacctctaaggaggcaaagcctttagtgtgcatttattaggtaccaactgggtgctttctgtatcaagcagagaaataaaagaggtcaaacacaa

SEQ ID NO: 174305 - DNA, 2771 bp, Homo sapiens
  Payload ID: 14207
  Gene Symbol: RHOT1
  Gene Name: ras homolog family member T1
  ENST ID: ENST00000578205
  CDS Start-End: 21-176
ggcccccgagagccgccgacatgaagaaagacgtgcggatcctgctggtgggagaacctagagttgggaagacatcactgattatgtctctggtcagtgaagaatttccagaagagattgttgtggatttaaatacctcctcatttgcagagtatcttcagccttcaacaaaatagaatgaaaacaacatatttaaaaaatctaacaccgaaacaccaaattaatccaagaatccactgagttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaa

SEQ ID NO: 174306 - DNA, 3231 bp, Homo sapiens
  Payload ID: 14207
  Gene Symbol: RHOT1
  Gene Name: ras homolog family member T1
  Uniprot ID: Q8IXI2
  ENST ID: ENST00000581094
  CDS Start-End: 64-1806
ctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgtaagtacttgctgtcttcattttcatgttgcatggttcataacattgcatgccattattagccatgaagggaatatctttgtcacataggaattgttcagcaacagaaagatactttgtaatgagaaggtacaaatttgagtaaatgcaagtttggtttgaatgccataataaaatgatataaacagtgcttctgacaatatctgtatatttttgagcaggctgtaactatcttaatagaatagtacaataaaacacaaccccccacccagcattaaaaaatagttttactggaataaaatgggtttggcatcatgttgttttatgcttataaagcattttcatatgaacagaaagtttatatttttctgtttttgaccttaggtatatgaagttttctaaaatattttattaatttatgttgaaattgtgggtatgcttcagttaggatatgtcttttttaagtgctgtaaagagtagttgtaattggaatttctactgtataaatgttttacattaagtgttacgagccacaaatttcatgtacatttattatatatctatacatgcatatgcacaagcacataactgtggtcatctctgtagtttactaactgccttaaaattgcatggttcttaatggcattcgcctcaagtagtgtgtttgtataaattctgttttgtaacaaaatagtttttcaggcagtgcgtttctcaggactttatagcttattctacttattcttatgttagtctctaaattatttttcttcttatgaaaactacagtgtaacacagagtaataatcaaacattgctataaaccaagaatgacatttttcaaaaaggtgttgatttgtacagatttttaaagtcagttaactttactgctattttattacctaatactttttttagatgcaacaaacccttgaatttctatttgtattcgaagacaagtcattcctattattatagaataaccaaaaccttatttatgttttacctttgctttaaaactctcatgtatgttatctacagagaggatcattacagagacagactctcccgagacatgggccacactgatagaatagagaatttgagaaaaatctgggtctttctaaaaactgctttgtaagttactttttctttatgacttctgtgggattttgttgatattttcttagagaatgaccaaatctcctttcttgccataattaacatttagtaattatgtagaaacgcactgcttggtcaggcttcctgcctagctatatattacgttgtcttccttactacataaatgtacttctttaatcttgtgattacagtaactgcaagtgtgtttttacatctgcatttttaaaacattttactgtaattctgttgtgtgtgtgtgtgttatatgataaatgtacatacatgga

SEQ ID NO: 174307 - DNA, 3289 bp, Homo sapiens
  Payload ID: 14207
  Gene Symbol: RHOT1
  Gene Name: ras homolog family member T1
  ENST ID: ENST00000583994
  CDS Start-End: 219-374
gccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagagattgttgtggatttaaatacctcctcatttgcagagtatcttcagccttcaacaaaatagaatgaaaacaacatatttaaaaaatctaacaccgaaacaccaaattaatccaagaatccactgagttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 174308 - DNA, 650 bp, Homo sapiens
  Payload ID: 14207
  Gene Symbol: RHOT1
  Gene Name: ras homolog family member T1
  ENST ID: ENST00000580392
  CDS Start-End: 1-403
cactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcatgaaaacagccctggaagtctgccctggcgcctgcactgagactaatccaggtcactttagggaaactgcccagctctggcaccgcactgtgtgtctgtcagctctgtggggtgctatggcctcattttcccactagaggacactgtggctccaggacttcatgtggcgcccagccagtcttgctactccagcacctctaaggaggcaaagcctttagtgtgcatttattaggtaccaactgggtgctttctgtatcaagcagagaaataaaagaggtcaaacacaa

SEQ ID NO: 174309 - DNA, 3013 bp, Homo sapiens
  Payload ID: 14207
  Gene Symbol: RHOT1
  Gene Name: ras homolog family member T1
  Uniprot ID: Q8IXI2
  ENST ID: ENST00000581031
  CDS Start-End: 126-2003
gggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacagaattatttctgcttaagtttagaaatgagccagaagcggccaggcgtggtggctcacgcctgtaatctcagcactttcggaagccgaggtgggtggatcacctgagatcaggagatcgagaccatcgtggccaacacggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaa

SEQ ID NO: 174310 - DNA, 680 bp, Homo sapiens
  Payload ID: 14207
  Gene Symbol: RHOT1
  Gene Name: ras homolog family member T1
  ENST ID: ENST00000584692
  CDS Start-End: 1-123
aaatcatttgtgatgttgtatgcctggtatatgatgtcagcaatcccaaatcctttgaatactgtgccaggatttttaaggaaaaaactggaaataatcaagatggctaacaatggacgatgatttactgaacaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggcc

SEQ ID NO: 174311 - DNA, 570 bp, Homo sapiens
  Payload ID: 14207
  Gene Symbol: RHOT1
  Gene Name: ras homolog family member T1
  ENST ID: ENST00000582602
  CDS Start-End: 1-570
tcagatgtaatgtaattggagtgaaaaactgtgggaaaagtggagttcttcaggctcttcttggaagaaacttaatggtgagaaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgc

SEQ ID NO: 174312 - DNA, 628 bp, Homo sapiens
  Payload ID: 14207
  Gene Symbol: RHOT1
  Gene Name: ras homolog family member T1
  ENST ID: ENST00000581148
  CDS Start-End: 1-471
gaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacaggttcttaactttatttactgggtaccaggcattctgttaaaatacaaaagaaaaaagcggataactatttattatacagatactcactacaaagacaagctgactgatgcccaactaacttccactaaaattctcactgtgatgacaatgtttagttttggaagcatccttaataatgtttttaaattaataggtat

SEQ ID NO: 174313 - DNA, 2539 bp, Homo sapiens
  Payload ID: 14208
  Gene Symbol: RHOT2
  Gene Name: ras homolog family member T2
  Uniprot ID: Q8IXI1
  ENST ID: ENST00000315082
  CDS Start-End: 115-1971
gacagcgcggggccgagaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatggacaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 174314 - DNA, 1044 bp, Homo sapiens
  Payload ID: 14208
  Gene Symbol: RHOT2
  Gene Name: ras homolog family member T2
  ENST ID: ENST00000561983
  CDS Start-End: 96-503
ccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcaggtgtgcccctgccccaccctcggtgcccagcccccttgaacctccgctgccgttagtgactggaacgggtcgtctccgggtggctggctgactcccaacaacgttctctcggaagcagaaatcctgctttgggcaccccctggccccgcaggccctggaggacgtgaagacggtggtgtgcaggaacgtggcgggcggcgtgcgggaggaccggctgaccctggatggtgaggccgggtgcccgcctgtgcctggggagtgtggggagggggctgtgcctggtgctccccctgctttgtctcggtgcaggtttcctcttcctgaacacgctcttcatccagcgcggccggcacgagaccacctggaccatcctgcggcgcttcggctacagcgatgccctggagctgactgcggactatctctccc

SEQ ID NO: 174315 - DNA, 708 bp, Homo sapiens
  Payload ID: 14208
  Gene Symbol: RHOT2
  Gene Name: ras homolog family member T2
  ENST ID: ENST00000570280
  CDS Start-End: 48-215
aggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggagaagccgagcagacggacgaggagctgcgggaggagatccacaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagac

SEQ ID NO: 174316 - DNA, 683 bp, Homo sapiens
  Payload ID: 14208
  Gene Symbol: RHOT2
  Gene Name: ras homolog family member T2
  ENST ID: ENST00000566214
  CDS Start-End: 50-292
ccaggtcggggccgggttccgggtcggggagcggctccgggcggcagctatgaggcgggacgtgcgcatcctgttactgggcgagggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccag

SEQ ID NO: 174317 - DNA, 625 bp, Homo sapiens
  Payload ID: 14208
  Gene Symbol: RHOT2
  Gene Name: ras homolog family member T2
  ENST ID: ENST00000561929
  CDS Start-End: 1-625
gacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtga

SEQ ID NO: 174318 - DNA, 530 bp, Homo sapiens
  Payload ID: 14208
  Gene Symbol: RHOT2
  Gene Name: ras homolog family member T2
  ENST ID: ENST00000569197
  CDS Start-End: 1-467
ccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagaacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattc

SEQ ID NO: 174319 - DNA, 1052 bp, Homo sapiens
  Payload ID: 14208
  Gene Symbol: RHOT2
  Gene Name: ras homolog family member T2
  ENST ID: ENST00000562333
  CDS Start-End: 14-421
ccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatgcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctg

SEQ ID NO: 174320 - DNA, 993 bp, Homo sapiens
  Payload ID: 14208
  Gene Symbol: RHOT2
  Gene Name: ras homolog family member T2
  ENST ID: ENST00000563637
  CDS Start-End: 50-268
ccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggcccc

SEQ ID NO: 174321 - DNA, 736 bp, Homo sapiens
  Payload ID: 14208
  Gene Symbol: RHOT2
  Gene Name: ras homolog family member T2
  ENST ID: ENST00000563134
  CDS Start-End: 95-736
cggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagaaatcctgctttgggcaccccctggccccgcaggccctggaggacgtgaagacggtggtgtgcaggaacgtggcgggcggcgtgcgggaggaccggctgacc

SEQ ID NO: 174322 - DNA, 4372 bp, Homo sapiens
  Payload ID: 14209
  Gene Symbol: RHOU
  Gene Name: ras homolog family member U
  Uniprot ID: Q7L0Q8
  ENST ID: ENST00000366691
  CDS Start-End: 667-1443
gggctccacggagtgaataggaggcggctcaggcttcctggctcgcgtgggcgccagaaagcggaacctcccgggccagtcgcgcggtggtcaccctcttgggagctggggaggaggctgcggaggctggcccggctccttcgggcgtcgcttcccggaccgggtgcgcggggtcccccggaacgtgtgttccaggtcctcccgcgccagtgttcgcagtccccgcctggtcgcggcggcgcctcgggcgcgggtgcaggcgcgcggcgcgcaggcggggggcgctgtggtcttggcgcggggaccgagccgctcggccagacccgcctcttttccctccccgccagcccgcccgcctgcccgccccccacgcgtcgtgtcgccgggaagccgggcggagacagagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaatataa

SEQ ID NO: 174323 - DNA, 1705 bp, Homo sapiens
  Payload ID: 14210
  Gene Symbol: RHOV
  Gene Name: ras homolog family member V
  Uniprot ID: Q96L33
  ENST ID: ENST00000220507
  CDS Start-End: 151-861
gggcggggccctacacaaacccgctggtagcgctgggccgactcgcccagcctggacccattcagtcagaggcagccagcgggacctgcttcaccgagcgcagcgaagccgagacccgggctggcccctctgctgcccccggagcgggccatgccgccgcgggagctgagcgaggccgagccgcccccgctccgggccccgacccctcccccgcggcggcgtagcgcgcccccagagctgggcatcaagtgcgtgctggtgggcgacggcgccgtgggcaagagcagcctcatcgtcagctacacctgcaatgggtaccccgcgcgctaccggcccactgcgctggacaccttctctgtgcaagtcctggtggatggagctccggtgcgcattgagctctgggacacagcgggacaggaggattttgaccgacttcgttccctttgctacccggataccgatgtcttcctggcgtgcttcagcgtggtgcagcccagctcctttcaaaacatcacagagaaatggctgcccgagatccgcacgcacaacccccaggcgcctgtgctgctggtgggcacccaggccgacctgagggacgatgtcaacgtactaattcagctggaccaggggggccgggagggccccgtgccccaaccccaggctcagggtctggccgagaagatccgagcctgctgctaccttgagtgctcagccttgacgcagaagaacttgaaggaagtatttgactcggctattctcagtgccattgagcacaaagcccggctggagaagaaactgaatgccaaaggtgtgcgcaccctctcccgctgccgctggaagaagttcttctgcttcgtttgagcagctatggctgcatagcaagtagtaggcaggaggccaaagacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggggctggcccctgggaagaactgggtctctgggctccctaggcactgcccaaactggctgagccaggagtggggcaggaagtgagagtcaaggcccagcaaaaggagggggaggagctgcaaattagaacctgaaggaggaccgggttggggatcatccctttcctcaaggtcacacagcctagaagctagagcagtgcagagtctgcaaataaaaccttaagtctgtgaa

SEQ ID NO: 174324 - DNA, 3308 bp, Homo sapiens
  Payload ID: 14211
  Gene Symbol: RASIP1
  Gene Name: Ras interacting protein 1
  Uniprot ID: Q5U651
  ENST ID: ENST00000222145
  CDS Start-End: 206-3097
ggcagggccaaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccaggactttgtggtgtatgtgatgacgcgagagcagcacgtgtttgggcgaggtgggaactcgtctggccgcggggggtccccggctccctatgtggacaccttcctcaacgccccggacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccgtggctgcccgcgcgccccggggccacgccgccaggccctggctgggccttctcctgtcgcctgtgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcgg

SEQ ID NO: 174325 - DNA, 546 bp, Homo sapiens
  Payload ID: 14211
  Gene Symbol: RASIP1
  Gene Name: Ras interacting protein 1
  ENST ID: ENST00000599291
  CDS Start-End: 1-546
cggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccagactctctattcaacgctgcctgctctcctggatagtaaccctttcacagctggtgcagagctgccggggcctggcgcggagctgggggccatgcctccaggattgagacctaccctgggcgtgttccaggc

SEQ ID NO: 174326 - DNA, 3165 bp, Homo sapiens
  Payload ID: 14211
  Gene Symbol: RASIP1
  Gene Name: Ras interacting protein 1
  ENST ID: ENST00000621604
  CDS Start-End: 66-2954
cagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccaggactttgtggtgtatgtgatgacgcgagagcagcacgtgtttgggcgaggtgggaactcgtctggccgcggggggtccccggctccctatgtggacaccttcctcaacgccccggacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccgtggctgcccgcgcgccccggggccacgcgccagccctggctgggcttctcctgtcgcctgtgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcgg

SEQ ID NO: 174327 - DNA, 3752 bp, Homo sapiens
  Payload ID: 14212
  Gene Symbol: RASA1
  Gene Name: RAS p21 protein activator (GTPase activating protein) 1
  Uniprot ID: P20936
  ENST ID: ENST00000274376
  CDS Start-End: 565-3708
ctgagagctccaggtagtgagcagttcagtcgatttcctcgttaccccgcccccctttctcttgcccccccacccctctcatctgcctggtggaggatgaagcggctgcagtggccccagcctcagcagcggcaccggcggtggctgcggtgtgggtggccggaactggggtggtgaagaagcggtggtggcggctgaaggagcggtagcagcctcagcctctttccctgtgcttcctttcctctttagtgcagcgaggaagttttcgcttctgtacatgtgtttgtgtgcgtgagtgtgggtgtgtgcggtgaggtttgggtggcgtttgtgcaggcgttgggttttttgcccacttggcttcccgtaacccaggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaaca

SEQ ID NO: 174328 - DNA, 3776 bp, Homo sapiens
  Payload ID: 14212
  Gene Symbol: RASA1
  Gene Name: RAS p21 protein activator (GTPase activating protein) 1
  Uniprot ID: P20936
  ENST ID: ENST00000456692
  CDS Start-End: 116-2728
gaccagaatacgaggaggaagaggtggccataccgttgaccgctcctccaactaaccagtaagttaagactgctgttcaggaatttgggaagctggctccagaaaagaagtggaaatgaaggggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataattgattacttct

SEQ ID NO: 174329 - DNA, 3009 bp, Homo sapiens
  Payload ID: 14212
  Gene Symbol: RASA1
  Gene Name: RAS p21 protein activator (GTPase activating protein) 1
  ENST ID: ENST00000506290
  CDS Start-End: 118-2763
gaggaggaagaggtggccataccgttgaccgctcctccaactaaccagtaagttaagactgctgttcaggaatttgggaagctggctccagaaaagaagtggaaatgaaggggttccatgtgccttgtgaagtcatggttcctcagtataagatcgaggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagcctt

SEQ ID NO: 174330 - DNA, 3060 bp, Homo sapiens
  Payload ID: 14212
  Gene Symbol: RASA1
  Gene Name: RAS p21 protein activator (GTPase activating protein) 1
  Uniprot ID: P20936
  ENST ID: ENST00000512763
  CDS Start-End: 202-2844
gaggaggaagaggtggccataccgttgaccgctcctccaactaaccagtaagttaagactgctgttcaggaatttgggaagctggctccagaaaagaagtggaaatgaaggggcatactacctggcgtcttcctacatttattgctcctctgggaaagtgtaaagtctttaagatggaaagcatgagaaaatgtgtatctaatgagaaccggatatagttctgtcccttccaagttgaggtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacat

SEQ ID NO: 174331 - DNA, 4979 bp, Homo sapiens
  Payload ID: 14212
  Gene Symbol: RASA1
  Gene Name: RAS p21 protein activator (GTPase activating protein) 1
  Uniprot ID: P20936
  ENST ID: ENST00000515800
  CDS Start-End: 565-2184
ctgagagctccaggtagtgagcagttcagtcgatttcctcgttaccccgcccccctttctcttgcccccccacccctctcatctgcctggtggaggatgaagcggctgcagtggccccagcctcagcagcggcaccggcggtggctgcggtgtgggtggccggaactggggtggtgaagaagcggtggtggcggctgaaggagcggtagcagcctcagcctctttccctgtgcttcctttcctctttagtgcagcgaggaagttttcgcttctgtacatgtgtttgtgtgcgtgagtgtgggtgtgtgcggtgaggtttgggtggcgtttgtgcaggcgttgggttttttgcccacttggcttcccgtaacccaggcagctggggagcctgggctgtggccctaggagggggcgcggcggcgggctctctccttttgttgttgtttcctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcagatgcagttagattggaagtctgttggcacaatcaaaagaaaggtccacattacacttgatggtaaaagagaaagaattgccagagtaaaaagaaggatcagatccttgaagcacaagttgaagattgtgaatgattcctattctggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggcctgggcaacaagagcgaaactctgtctcaaaaaaaacaaaaaaaaagaagatttgtatttctaaatgcaattttacgattcccttaaagaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcataa

SEQ ID NO: 174332 - DNA, 5614 bp, Homo sapiens
  Payload ID: 14213
  Gene Symbol: RASA2
  Gene Name: RAS p21 protein activator 2
  Uniprot ID: Q15283
  ENST ID: ENST00000286364
  CDS Start-End: 36-2585
aggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctgaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctg

SEQ ID NO: 174333 - DNA, 2562 bp, Homo sapiens
  Payload ID: 14213
  Gene Symbol: RASA2
  Gene Name: RAS p21 protein activator 2
  ENST ID: ENST00000452898
  CDS Start-End: 1-2562
atggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccagtttttattttaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctgaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttag

SEQ ID NO: 174334 - DNA, 494 bp, Homo sapiens
  Payload ID: 14213
  Gene Symbol: RASA2
  Gene Name: RAS p21 protein activator 2
  ENST ID: ENST00000515549
  CDS Start-End: 38-181
gcaggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataac

SEQ ID NO: 174335 - DNA, 4191 bp, Homo sapiens
  Payload ID: 14214
  Gene Symbol: RASA3
  Gene Name: RAS p21 protein activator 3
  Uniprot ID: Q14644
  ENST ID: ENST00000334062
  CDS Start-End: 123-2627
tgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcactgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctcagggagccacggcccgtctagtcgactgtgacatgcacctccggccgtgtgtgcgtcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaattacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttctga

SEQ ID NO: 174336 - DNA, 4191 bp, Homo sapiens; identical to SEQ ID NO: 174335
  Payload ID: 14214
  Gene Symbol: RASA3
  Gene Name: RAS p21 protein activator 3
  ENST ID: ENST00000630618
  CDS Start-End: 123-2627

SEQ ID NO: 174337 - DNA, 5605 bp, Homo sapiens
  Payload ID: 14215
  Gene Symbol: RASA4
  Gene Name: RAS p21 protein activator 4
  Uniprot ID: O43374
  ENST ID: ENST00000262940
  CDS Start-End: 69-2480
cagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaaaggaggagtgggctttgaacttagacatctacctcagagctcaaataggttgtttaaaatcacattcaattttcagatgaaggggaactttatagttttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtata

SEQ ID NO: 174338 - DNA, 2787 bp, Homo sapiens
  Payload ID: 14215
  Gene Symbol: RASA4
  Gene Name: RAS p21 protein activator 4
  Uniprot ID: O43374
  ENST ID: ENST00000449970
  CDS Start-End: 68-2341
agtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactg

SEQ ID NO: 174339 - DNA, 2634 bp, Homo sapiens
  Payload ID: 14215
  Gene Symbol: RASA4
  Gene Name: RAS p21 protein activator 4
  ENST ID: ENST00000462172
  CDS Start-End: 359-2554
ggaccccggtgtctggcttcccccgagccgggaccccgcgatggccaagcgcagctcgctgtacatccgcatcgtggaggggaagaaccttcccgccaaggacatgtgagcgcggccgggggtgggagccccaactttccggggaggggcactgccccccaggacgcctgacctttccggggtccacccacaagagcagcggagaggcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcacccc

SEQ ID NO: 174340 - DNA, 3244 bp, Homo sapiens
  Payload ID: 14215
  Gene Symbol: RASA4
  Gene Name: RAS p21 protein activator 4
  ENST ID: ENST00000461209
  CDS Start-End: 601-2796
ctctcagccccctccctctgtctcctcttccctctctctcccctccctgtccgtccccttccctttctgcccctccctctgtccctctcccagtctctccccttcctccttccccctcctttcttctcctttctctctctacccatccctgtctcctccccctccttctccctcccccacaactctccctccatctactcccacccctgcccgcgaaaggggagccctggtgcgggttcctgcccttccctcaccatccgctcccgggctgagggcggggacccgtgtttggccggaggagcctgcggtctccaaaccaggacgcggagactcagcctccgctctcttcccccgcactcctcccgaggggccaaaagagagaggagcctgccgcgagtccccgccccgatcccgccctccagccccgcccctgcctatttgtcttgcagcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 174341 - DNA, 485 bp, Homo sapiens
  Payload ID: 14215
  Gene Symbol: RASA4
  Gene Name: RAS p21 protein activator 4
  ENST ID: ENST00000521076
  CDS Start-End: 322-485
gcgatggccaagcgcagctcgctgtacatccgcatcgtggaggggaagaaccttcccgccaaggacatgtgagcgcggccgggggtgggagccccaactttccggggaggggcactgccccccaggacgcctgacctttccggggtccacccacaagagcagcggagaggcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaaggggatctggccccaaaggaccgcaatggcacatctgaccccttcgtccgagtgcgctacaagggccggacacgggagacctcg

SEQ ID NO: 174342 - DNA, 817 bp, Homo sapiens
  Payload ID: 14215
  Gene Symbol: RASA4
  Gene Name: RAS p21 protein activator 4
  ENST ID: ENST00000521397
  CDS Start-End: 1-817
gtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctcc

SEQ ID NO: 174343 - DNA, 516 bp, Homo sapiens
  Payload ID: 14215
  Gene Symbol: RASA4
  Gene Name: RAS p21 protein activator 4
  ENST ID: ENST00000520042
  CDS Start-End: 223-516
tgaaggccgactgggcaggagggacagcggtgtcggtgttggggagagcaggagcaaaggctccagggagacactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcg

SEQ ID NO: 174344 - DNA, 615 bp, Homo sapiens
  Payload ID: 14215
  Gene Symbol: RASA4
  Gene Name: RAS p21 protein activator 4
  ENST ID: ENST00000519539
  CDS Start-End: 1-412
cccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgactggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtg

SEQ ID NO: 174345 - DNA, 967 bp, Homo sapiens
  Payload ID: 14215
  Gene Symbol: RASA4
  Gene Name: RAS p21 protein activator 4
  ENST ID: ENST00000522801
  CDS Start-End: 50-967
cgccaccccggaccccggtgtctggcttcccccgagccgggaccccgcgatggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggac

SEQ ID NO: 174346 - DNA, 483 bp, Homo sapiens
  Payload ID: 14215
  Gene Symbol: RASA4
  Gene Name: RAS p21 protein activator 4
  ENST ID: ENST00000538869
  CDS Start-End: 1-483
atgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagcgctccaaacagggaaaccccaagccttgctggcttctgccaaccccctgagcagaagcatgggtccccctgatcaccacctcaccaccctcatcctgatctcactgtacacaccctttcccggtctgctaagtagcgggtgtttttccttgacactaacgctacagctagaccacggtgggcttggcaacaggtgtcttcccagatgctggcgttaccgctag

SEQ ID NO: 174347 - DNA, 2589 bp, Homo sapiens
  Payload ID: 14216
  Gene Symbol: RASA4B
  Gene Name: RAS p21 protein activator 4B
  ENST ID: ENST00000306682
  CDS Start-End: 364-2559
accccggaccccggtgtctggcttcccccgagccggcaccccgcgatggccaagcgcagctcgctgtacatccgcatcgtggaggggaagaaccttcccgccaaggacatgtgagcgcggccgggggtgggagccccaactttccggggaggggcactgccccccaggacgcctgacctttccggggtccacccacaagagcagcggagaggcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcc

SEQ ID NO: 174348 - DNA, 2931 bp, Homo sapiens
  Payload ID: 14216
  Gene Symbol: RASA4B
  Gene Name: RAS p21 protein activator 4B
  Uniprot ID: C9J798
  ENST ID: ENST00000465829
  CDS Start-End: 72-2483
gcccagtccagcgcccgccgcccgccaccccggaccccggtgtctggcttcccccgagccggcaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtc

SEQ ID NO: 174349 - DNA, 2794 bp, Homo sapiens
  Payload ID: 14216
  Gene Symbol: RASA4B
  Gene Name: RAS p21 protein activator 4B
  ENST ID: ENST00000541662
  CDS Start-End: 68-2341
agtccagcgcccgccgcccgccaccccggaccccggtgtctggcttcccccgagccggcaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacagaggtcgaccccgacgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccgtggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcaccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggc

SEQ ID NO: 174350 - DNA, 3382 bp, Homo sapiens
  Payload ID: 14217
  Gene Symbol: RASAL1
  Gene Name: RAS protein activator like 1 (GAP1 like)
  Uniprot ID: O95294
  ENST ID: ENST00000261729
  CDS Start-End: 317-2731
gtgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtcta

SEQ ID NO: 174351 - DNA, 3040 bp, Homo sapiens
  Payload ID: 14217
  Gene Symbol: RASAL1
  Gene Name: RAS protein activator like 1 (GAP1 like)
  Uniprot ID: O95294
  ENST ID: ENST00000446861
  CDS Start-End: 289-2619
ttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctg

SEQ ID NO: 174352 - DNA, 2502 bp, Homo sapiens
  Payload ID: 14217
  Gene Symbol: RASAL1
  Gene Name: RAS protein activator like 1 (GAP1 like)
  Uniprot ID: O95294
  ENST ID: ENST00000548055
  CDS Start-End: 43-2460
acctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagg

SEQ ID NO: 174353 - DNA, 3817 bp, Homo sapiens
  Payload ID: 14217
  Gene Symbol: RASAL1
  Gene Name: RAS protein activator like 1 (GAP1 like)
  Uniprot ID: O95294
  ENST ID: ENST00000546530
  CDS Start-End: 287-2707
ctagaacgagatggaaggggatgttcaaggcccctcccttgactctgaacggacccccagggaacatgcgaccctctctctggcgacgcctcccacccaccactaatacttgctcctggaccggggggcgcggaggttggagagaggagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccagcaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgagggtatatgaaggcaagaatcagggttatttaacagattccgtaggtcatttggatgagtatcagctttgaggaccacaggcctggggaatgggcaattttattttattttgtttttagagttgggggtctcactctgttgcccaggctgcagtacagtggcatgatcataggtcagtgcaccctcaaacttctggacttcagtgatcctcccacgttagcctccagagcagctgcgactacaggtgcaagccatcacgcctggctaatttttaaatttttgtagagatggggggtctcactatgttgccca

SEQ ID NO: 174354 - DNA, 4378 bp, Homo sapiens
  Payload ID: 14218
  Gene Symbol: RASAL2
  Gene Name: RAS protein activator like 2
  Uniprot ID: Q9UJF2
  ENST ID: ENST00000367649
  CDS Start-End: 353-4195
gaagaaggcggctccgaggaggtgggagggcgagcctcccctcccgggttcttctgcgtcctctcccgggagggacccacacacacctgagcccggacccacccttggtcggggccacgctggatcctcctcccggcctgggtcccgcccgccgactgcaggtgggctgcatcgcccgagcctcgggcagtgggcgacggggaaggaggtgagaggtgtccgcgccggctgccgctcgggtccctgccctcgctgcgcgctctcctcctccccttaccgcaggcagggcgcggagccgcgcgccagcccgccccgaagccgccgcctcgtccccctcccgcctcggggcaccatggagctctctccgtcgtccggaggagccgcggaggcgctgtcctggccggagatgttcccggcgctggagtccgactcgccgctgcccccggaggacctggacgcggttgtcccagtcagtggagccgtcgccggtggcatgttggatcggatccttctggagtccgtgtgccagcaacagagctgggtccgggtgtacgatgtgaaaggaccacccacccaccgtctgtcttgtggtcagtcaccctacaccgagacaacaacgtgggagcggaagtattgcatcctcacagacagccagttggtattgctcaacaaggagaaggagatacctgtggaagggggacaggagcagcagacagattccaccaaagggcgatgcctgaggagaactgtcagtgtcccttccgagggtcagtttcccgagtacccaccagagggcgccactaaactggaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaat

SEQ ID NO: 174355 - DNA, 2385 bp, Homo sapiens
  Payload ID: 14218
  Gene Symbol: RASAL2
  Gene Name: RAS protein activator like 2
  ENST ID: ENST00000433130
  CDS Start-End: 1-2080
agaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggtcataaatggagatgagattattcaaacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagatt

SEQ ID NO: 174356 - DNA, 14453 bp, Homo sapiens
  Payload ID: 14218
  Gene Symbol: RASAL2
  Gene Name: RAS protein activator like 2
  Uniprot ID: Q9UJF2
  ENST ID: ENST00000462775
  CDS Start-End: 126-3545
cgaaatgagagcaaaaagggagagagcaggaaagcgagcacaggcgagtacagtatacaaagtgttttgagtttctgactggcgtgccggaaagatcatgttagcacacccagaaacttcacacgatgcagaccccagaggtaccagcagaaaggtcccctcgtagacggagtatctcagggaccagtacatcagagaaacccaactccatggacactgcaaatacctcacccttcaaagtaccaggattcttcagcaagcgcctgaaaggctccatcaagaggaccaaaagccagtcaaagcttgacagaaacacgagctttcggcttccatcccttcgcagtacagatgacaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggttacctacttaagtggaagtaaatgcttcagctgtaattctgcttctgagagagacaagtggatggaaaaccttcgcaggacagttcaacctaataaggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactgtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggttcagtcacctgtggactctgccacaatgtccccagtagagaggacagcagcctgggttctgaacaatgggcagtatgaagaggatgtggaagaaactgagcaaaatctagatgaagccaagcatgctgagaagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggctaatggctgtggaagaggaactgaagaaggatcatgctgagatgcaagcagttattgatgcaaagcagaaaataattgatgcacaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttcaagtaggtaaataactttgtttgctgggaggaggtacatggctgaagagaggcaaatagattaagatagcaatgtcttgcacttcctgtttccctcaaaacaacaccacattgtggggcgcaggatagatcagggttgagtggaatttggaattcaggtgaagtgcttgtaaagtgcatgtctagctgacaacagacttgaccattaatgaggacagtgttggtaggagtcagaaaagagcttcatattccccttttatattactgaagcaataagcaatctgagctgaagcagcaaaaagagtcacatttccatcaggtcatcatattccctgagtctctgcagcaaaagccatgtcagaggggagattataactaggtaactataacaagcacttgagcacttaccatgttccaagcactatcaccaaggtactgttggggtttatggcagtctaacggtaagaaaaatgtggtaaaatgaggtaatcatgctgctatagctttttgctttttttcatatagtatcaagttggtcagaattagctttctctgactggtctgcttccgtgtttctctgtgatggtgttaagattatgaaagaaaaagaagattacctaagactgctacaagtgttaactatatgcccttaagaatgagcttgactttggaagtaaagcttttcagatcttagtctacccggggcctttgttgatgggtctgtggttctgtagacccctggctttcactgtgttctcagaggtacaccagattgagagcagagttcttctttggaagtcccagagcaaaataactgccatcaagtgagtttgcattcgtatttgtttccccttccatagagggttagttttagttacctctagcttggagttcctgagaaggctggttataggactgagcgtgggaaaggaaccctcttcaggattacctcagtcccatcagtctaccccattgtgacattgagcccaacacacacgcttgacaccagactagacttgtcacagggccaaacccaacagccacatgccatagcttcactgcattttcagctacacctttggaggccaccttctcctatcaactgtggaaagccagaagggctcccttctccattctccttccctttttcaagtctaatagtgaaatctcctgcttaccccagcagtaaatagttgccttcctaccccttacctgggggccgataatttgagatactttgttttttcaatgcgtcagttgaaggatttagtttcttaaaagcaagaaatgttggagtgttgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacacaaaacataattcctggggcttcctttttctgaatgttaatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaagttttttgtttttttttttagtttgagacttaaaaccagatttatttgttgttgtagagagatttccacagaagttgtgttttagggacctccatcatctttgtgggggtacagatatttatgtgtaaatatcattttatgtgatttccaaattttcgagggaaacatttcaattcccagttcaacaaaaggttaaatactaattgactcaatgaccaccttcaggaaagttaaatagtaaattaggttaaattttgactggtgcttagacatttcctagttatattaacttaagcagacagcagcacattaacctgagttacacctgtgaggaaatgaccttctaaatttgattttgtttttcatctccagggccttaataagagtgtgttaacacacgactattttacaatgatagctctaaataatttattttttatttcaagaaagagaaatacaccttagaaaaacaaaacccaagattttattttatttttaaagccatatttttgtgctagtagcatttagattattccgtatgtgagatccgtatcagcatttcattacctgggtttgttctaaagaagatttatttttgttctgtgaataatttttgacagttcttgtacatgtacagatatagatacgtttgaggtcttttattgatattcctacaaagaatacaaataaactttaactttaaacatttcagactaaagttgctactatatttgacatattgctgtcttctagcatgcacctgggtgactaggacacttgaagagaaacaagaaaggaaatgtatgccggaatattcttctaaaaatatattttaacattaagaacagtctgtcctagaatttcccaacttccatgtaataagatttcaatttaggaaaaataactagcattagcatgtattgtgataaaactgttactttcgaattctgcagaatttgaaatctctttaataacttgtgacaggtaaagaaagtttcatctggtttattaggaaatgtagccccacttagcttcctagaccactaccatcctcttgtaattttccagttagattaatggggtttgttttcaggatttttgatgtttggttcaggttttttattttaatttcttaatagaagttcatttgtcattcccaacatgattgttcccaaatacacccatcttctcctgcatccctgtttcattctgtaaaatccagggatgcaggtttcatgtgtagtcttgttttgtgttagttgtaggtctgtgctttttggcacatgtcgagttcttcctaatcttgttctactagggattaaaaaattaaaatttactcaaaatccagagaagattgcatgaaacagaaactgcatatccaagaattgtgctattttttgttcacttcgaagctgacccatttcagtctaaattgttcgtgacctaatgtaagctttaagacttcctggatctgaaacatcaaaaagagagaaagtgttgatgcggtctttttacttcatggtcctcttagccctaaactatccatccgtataccctttatgcatatccataccctgtaattgtttttagcctccctccagctgcctgactttttttattagcattttaccagtaggaaaatacataaattaattttgttagcaaaaaaaaaaatttaatgacaaagaacactaaaacagatgactaaatcagtggttttcaatcctgattgttcatcagaatcactggagagttgtttaaaaaaaaaaaaaaagaaaaaaaacagaggagtacctcttgagctccaccattgaacaattaaatagaatctctctaaggattgggcctggccaggcttttttttttttttttttctttttaaccttgccaggggattccgaagagccagggggtaagaaacactagtccaaatcaagctgtgagcactgtgcgtagctgtcttaaaatgttttctgtccccaatcctgaaactggggtaagttggttacaggtgtttccttcccttctatttggaatttaaaattctactaaaactgacaatatatactcagccttcccccacatacaccttgtccccaccaatctgtcctttaagtctgtgaggtagaaattctctccattaacatggtcatcccatttatggaatagatacattctgacaaagctgaccagaagatggaattccctatttcgacctcagtttccccactggcttcaatttaaagcagaaggtaggtggcttctggtttggagtcagaagcttcaatgagtacaccccttgaggagtgctgaagggcccaggccagaatcaaatatgctacatttgactttaaagagtaaacaacagtggctcacgcctgtaatcccagcactttgggaggccaaggcaggtggatcacaaggtcaggagatcgagaccatcctggctaacatggtgaaaccccatctctactgaaaatacaaaaaattagccaggcgtggtggcgggcacctgtagtcccagctactcgggaggctgaggcaggagcatggggtgaactcaggaggtggagcttgcagtgagccgcgatcacgccactgcactccagcctgggcgacagagcaagactccgtcttaaaaaaataaaaattaaaaaaaaaagtaaacaacatagagaactcaaaagttcctttgtctacctccaccaccccccaccaaaaaaaaaggcccttaactacatttgactttaaggaataaacataagagaactcagaattcctttgtctctccccacccaaaaaaaaagaaaaggttcttaacttttcttgacctaatattcagcactgaagtcttattacttgaaacttatcagatgctaaattacaccattcatacttattgttctttcaatagcaaaatgtactgaaagctctccagtcccccctccactcctggcaagcatgcagtcacgtgctcgtgtgaattttccaaaatcatgagcattttgtaagattcagttggttatatgaaattacaataaagagtattatatattttattataatttgtaaattgtgtgctatacattctttatatcagtaaaatttatagtaaacacatatacattatatactcacacacacatattactggtctttctagaaacttgattttgtgaaattctagaatgaattcccagggtgatatttgtttggcctatgaataaattgcaatgaactaacaggtaaatgccaatgtttccttgtctgtaaaattaagattgtggctaaatggtgtatagggtactctctagcactgacattctgtggttattatctgatataattgagaaatgtgtccttagactatgttcaaaaatcggcttgaagcttttctctcagtatttaggaacaattcttcctccacagtctcccatggcacagtagtttttaagaaccaaaaaaaataaagtctggaacaaatgtatattcagaacactacagtgataatgttgataataataatagctggccaggcgtagtggctcacgcttataatcccagccctttgggaggctgaggcaggagtattgcttgagcccaagaattggaggttgcagtgagctataatcacaccattgcactccagccaaggtggacaaagcaagaccctgactcaaaaataatagctaatgtttattgagcaccaactatgtgtcagattatttgctaagcactttatatggaatatatcatttaatcataacaccaaccatgtgagttaggcattattattatcattcttatttcaggaggaaactgaggctcagaaagactaagttacttgcccaaagctacacaatggataagggcaaaactaagacccacgctcagatccctctgaccgtgctgtcttgaccaaaaaaaaacaaaaaaacaaaaaaacaacaaaaaaaaaaacttaggaaagacattggagagggtaagaaaagatccaaaaagatcttgccacataaccaacttgtcaccatgagccaaagtgatggcagtggaacaagatgaggtcatattccacaggttttccaccttaatatattggtttttataagattgtcttgcaatgtccaatcatctgatcagaattagaagagtgtgcagaagtctcacctgtctcagaaattggtctttcatctcttctgggtccatcagagttgagatggtaaagtctgctttcaagattccaaaagggtgccctgaaaaagaaagtgctacctgttcagggggatattatcctatttccatttcaagttcttagcagtcaggagcacccggtggacaccatagatgctacatgttgatttgggatttcaagaagaagaaagaaactgctgagcagaagaatgctcagccacaattagggttaaccaattagtggctgaaaaaaagagtcccatgctttgggtaatgcgaagtcttccacagcctggctacccatcaggcaattattttcttttttgtttcttctgtatttttctccttacttttaatccagtaagtagatactccacaccatgccggaaatactcatctctccttgagctccccaccacagaaaattctaaagaagttctctgactttttaaataaatccagcctttgcccgtgagccatccataatcattacaggaactacaatctcataataagactatatttgcattgcattttattgtttataaagtttatagttatctcattgggtgctcacaacaacgctgtgatataggcagggtagtttttaccacatccccttcacagaagagaaatagaaattcagaaacttgtcccctaagttttcataatagtcatggagcataaactagaatccacctctttattactatccctattcccaacatttcatgctgtctttcatgaaaaggtctcaagggccctgtgccaaggagtgactgtccagatttaactgctccactggtaagagtaggaacttggtagacagaagcagttacctgatttttgtgctgatgttttttctttagattctgaactcagatgttgggcctccgtggcagcagctgtatctcttctatcagtgccactccctacactggccacagctacaggaggggaaaataaaagatttattgcaaatacaaccaggagtaaggtggcctgatattggtgactgcccctgagctaaaagacaggcaaggacagccactgctaggcacacagttgctgcagaagccagcgatgtgggaagctcaattcctgccaatccctgactcacccctacaggctcttttaacccagcacttgagttgctacaccatcatctttcagaaagcccccctggcagcaggacctgtggggcttgggcaatgttaggaggtttttcctcatcaaattttttttgttcagtagcctgtgctccaaagggcctaatgtccttattttgtctgccagctacacaaagcccccaccatggcacccagggaccctcaatatcgccatctccatcccaaaccaagttcaggctctcccccagcaccccctctcttcctgtatggctggccatgcccggaggcgctccagccagagaccctggtgtcctcagcggctcccttgctccatctcacctgctctcatgttcagtcaccaaagtcctgtcagtgccttgcagatgtcttattttttcaaatatggaaataatccttttatttggaatatattattgtaaaatatgtaagcaaatttgtcccctccccaacccagggacacccatgattaacactttgctgtagaaggtccttcacactctcgaatttgttaatttgaatgtgtaaagatctcccttgttctctttaaaggctgcatagtagtatttcactgaatgtaccataacttatttaaccgatctgctttcagtggacattacgttgtttccaccttttcactgtaataaacaatgccgcaacaaac

SEQ ID NO: 174357 - DNA, 3293 bp, Homo sapiens
  Payload ID: 14219
  Gene Symbol: RASAL3
  Gene Name: RAS protein activator like 3
  Uniprot ID: Q86YV0
  ENST ID: ENST00000343625
  CDS Start-End: 87-3122
gttccgagggaggaagccaggcggggtgcagacggctgctgattctggggctggtcaggaaaccaaggagacccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctgagccaccaggagcccatggtcagcacccagccagcccctcgctcgatattccgtcgggtcctatctgcgcctcccaaggagtcacggaccagtcgccttcgactctccaaggccctctgggggaggcataagaacccaccgccggagccagacccggagccggagcaggaggccccagagctggagccggagccagagctggagccccctaccccacagatccctgaggcccccacacccaacgtgcctgtctgggacattgggggcttcaccctgcttgatgggaagctggtgctgcttggaggagaggaggagggtcctcgaaggccccgggtgggaagtgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccaggttggagccccgggatggaccccccagtgctctgggctctagggagtcgctggccacactctctgaactggacctgggtgccgagcgggatgtgcggatctggccactgcaccccagcctcctgggggagccccactgctttcaggtaacctggacgggtggaagccgctgcttctcttgtcgctcggccgctgagagagaccgctggatcgaggaccttcgtcgccaattccagcccacccaggacaacgtggagcgggaagagacatggctgagcgtgtgggtgcacgaagcgaaggggcttccccgagcagcggcgggggcacccggcgtgcgcgccgagctgtggctggatggcgcgctgctggcacgcacggcgcctcgggccggcccaggccagctcttctgggccgagcgcttccacttcgaggcgctgccaccggcacgtcgcctgtcgctgcggctgcgcggcttgggcccgggaagcgcggtgctgggccgcgtggccctggcgctggaggagctggacgccccacgcgcgcctgccgccggtctggagcgctggttcccgctgctcggggcgccggcgggcgcagcgctgcgggcgcggattcgggcgcgtcgcctgcgcgtgctgccgtccgagcgctacaaggagctggcggagttcctcaccttccactatgcgcgcctctgcggggccctggagcccgcgctgcctgcgcaggccaaggaggagctggcggcagccatggtgcgcgtgctgcgggccaccggccgggcgcaggcgctggtgactgacctgggcactgcggagctggcgcgctgtggaggccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggagctcagagtttgattcagagcacaacctaacaagcaatgaagggcacagtctgaaaaacctggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 174358 - DNA, 1473 bp, Homo sapiens
  Payload ID: 14219
  Gene Symbol: RASAL3
  Gene Name: RAS protein activator like 3
  ENST ID: ENST00000599694
  CDS Start-End: 1-1336
ccgtgaggcgctgctgttccgggaaaacacattggccaccaaggctatcgatgagtacatgaagctcgtggcacaggattacctccaggagaccctgggacaggttgtgcggcgtctctgtgcttctactgaggactgtgaagtggaccccagcaaatgtccagcctcggagctgccagagcaccaggccagacttcggaacagctgcgaggaggtcttcgaaaccattatccattcctacgactggttccctgcggagctgggcatcgtgttctcaagctggcgagaagcatgtaaagaacgtggctctgaggtgctgggcccccgactggtgtgcgcctccctcttcctgcggctcctgtgccctgccatcctggcacccagcctctttggtttggcaccagaccatccagcacccggcccagcccgcaccctcacactgattgccaaggtcatccagaacctcgccaaccgtgccccgttcggtgagaaggaggcctacatgggcttcatgaatagcttcctggaggaacatggaccagccatgcaatgcttcctggaccaggtagccatggtggatgtggatgctgcccccagtggttaccagggcagtggtgatctggccctccagttagctgtcctgcatgcccagctctgtacaatttttgctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaaggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtat

SEQ ID NO: 174359 - DNA, 1717 bp, Homo sapiens
  Payload ID: 14219
  Gene Symbol: RASAL3
  Gene Name: RAS protein activator like 3
  ENST ID: ENST00000609274
  CDS Start-End: 1-687
gctgagcttgaccagacaacccgagacaccctggaaccactgcccaccatcctgcgagccattgaggagggccagcctgtgcttgtgtcagtgccaatgcgtctcccactgcccccggcccaggtccactccagcctctccgcaggggagaagcccggcttcctggccccccgggacctccccaagcacacccctctcatctccaagagccagtctctgcgcagcgttcgccgctcagagagttgggcccggccacggccggacgaagagcggcccctgcggcggccccggccggtgcagcgcacgcagagtgtcccggtccggcgtcctgcccgccgccgccaatctgcggggccctggccgcgacccaaaggctccctgagcatgggaccagcgccccgcgcccggccttggacccgggactccgcctcgctgcctcggaagccgtcggtaccctggcagcgccaaatggaccagccgcaagaccgaaaccaggcactgggcacgcaccgacctgtgaacaagttggcagagctgcagtgcgaggtggccgctctgcgtgaggagcagaaagtgctgtcccgcctcgtggagtcgctgagcacccaaatccgggccttgacggagcagcaggagcagctgcggggccagctgcaggatctggactccaggctccgtgctgggtgagcccagccctctccattagctccgcccccaggtgggcccgatccaattagatctgaccaggccctcccccccccccccaaaccacgcctagcacggccaagccccaccctggccccgccccaataagtctgtccaggccctgcctcttggcaagccccgcccccaggtggacccacccaacgaaggtcggcctaggaccctggcagattctctcatccaggccccacccctccatcagcccctcccaacctggctgggccgggcactgagatatctcagcctgggcactccctccagctcagtcacgaccccacccaggactggccaaaccccacctccaagggatgattgataggtcctgtcattccaaccattcccgtctctggtccgacccttcttcaagcatatttaggccccgcccctcagtctggacaagctccgcctccactccaagctccgcccccggagtccctggcactcccaccaggagctggaagggacttccttagcctctgcccttcgccccaatcccccgacccccacaggagctcagagtttgattcagagcacaacctaacaagcaatgaagggcacagtctgaaaaacctggtgagattgccatctgagccctggggcaggtctgggcggtggaggagcaagggttgcggtgcagccctctcctggtttctgaaccccatcaccactgcctccccaggagcaccgcctaaatgagatggagagaactcaggctcagctgagggatgctgtccagagcctgcagctttctccaaggacgcgggggtcttggagtcaaccccagcccctcaaagcaccctgcctcaatggagacaccacctgagctgcccatcctgcctcatcacacgtggtctgggagcagagagatagccatcttagggggggtgtctgactttgccttagccctacttggcctacagtggggagtggagctgctggtcccaaccactctggcagtatgaagttgcccagtaaaatcttgatttcagtgaaa

SEQ ID NO: 174360 - DNA, 2850 bp, Homo sapiens
  Payload ID: 14220
  Gene Symbol: RASGRF1
  Gene Name: Ras protein-specific guanine nucleotide-releasing factor 1
  Uniprot ID: Q13972
  ENST ID: ENST00000394745
  CDS Start-End: 1179-2648
ggagccctttttggcctacttggggtgagtcaacataaggagtgcaggccaccttagcctttgcttctcaaaagtcatggggcaatgaaggacttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaagcaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtc

SEQ ID NO: 174361 - DNA, 6294 bp, Homo sapiens
  Payload ID: 14220
  Gene Symbol: RASGRF1
  Gene Name: Ras protein-specific guanine nucleotide-releasing factor 1
  Uniprot ID: Q13972
  ENST ID: ENST00000419573
  CDS Start-End: 276-4097
cagtttgcccggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagaggaccagggaggggaccagggaagcagaaatgagcaggtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 174362 - DNA, 6237 bp, Homo sapiens
  Payload ID: 14220
  Gene Symbol: RASGRF1
  Gene Name: Ras protein-specific guanine nucleotide-releasing factor 1
  Uniprot ID: Q13972
  ENST ID: ENST00000558480
  CDS Start-End: 267-4040
cggcaccggaggagggtcgggcggcatcttccgggtactggggctctgcggagcggagaagaggttccagcggggaatggtatatctggattcaagaagccgcggctcggcgccagatcctggagtgtagatatttggggggaggggagagctagagggagcgagcgagcgagcgccagagagaggcagcgcgcagcgcgcacggacggggggctgctgcgcggagaagatgtaagcgcgtggggtctcgctggcctctgagcaccatgcagaaggggatccggctgaatgatggccacgtcgcgtccctgggactgctggcgcgcaaggacggcacgcgcaaaggctacctgagcaagcggagttcggacaacacaaaatggcaaaccaagtggttcgcgctgctgcagaacctgctcttctacttcgagagcgactcgagctcgcggccctcggggctttacctgctggagggctgcgtctgcgaccgcgcgccctcccccaagccggcgctgtcggccaaggagccgctggagaaacagcattacttcacggtgaacttcagccatgagaaccagaaagccttggagctgaggacagaggacgcaaaagattgtgacgaatgggtggcagccattgcacatgccagctacaggaccctcgccacagagcatgaggcattaatgcagaaatacctgcacctgctgcagatcgtggagacagagaagaccgtggccaagcagcttcggcagcagatcgaggatggggagatcgagatcgagcggctgaaggcagagatcacatccctgctcaaggacaatgagcgcatccagtccacccagactgtcgcccccaacgatgaagacagcgacatcaagaaaattaagaaggtgcagagcttcctgcggggctggctgtgccggcggaagtggaagaccatcatccaggactacatccggtcaccccatgctgacagcatgcgcaagaggaaccaggtggtgttcagcatgctggaggctgaggctgagtacgtgcagcagctgcacatccttgtcaacaatttcctgcgcccgctgcggatggccgccagctccaagaagcctcccatcacacacgacgacgtcagcagcatcttcctgaacagcgaaaccatcatgtttttacatcagatcttttaccaaggcctgaaggcccgcatctccagctggcccacgctggtcctggctgacctatttgacatcctgctgcccatgctcaacatctaccaagagttcgtccgcaaccaccagtacagcctgcagatcctggcccactgcaagcagaaccgtgacttcgacaagctgctgaagcactacgaggccaagcctgactgcgaggagaggacgctggagaccttcctcacctaccccatgttccagatccccaggtacatcctgaccctccatgagctcctggcccacacgcctcatgagcacgttgagcgcaacagcctggactacgccaagtccaaactggaggagctgtccagaataatgcacgatgaagtaagtgagacggagaacatccggaaaaacctggccatcgagcgcatgatcatcgaaggctgtgagatcctcctggacaccagccagacctttgtgagacaaggttccctcattcaggtgcccatgtctgaaaagggcaagatcaccagggggcgcctggggtctctctccctaaagaaagagggcgagcgacagtgcttcctgttttctaagcatctgattatctgtaccagaggctctggagggaagcttcacttgaccaagaatggagtcatatccctcattgactgcactttattggaggagccagaaagcacggaggaggaagccaaaggatccggccaagacatagatcacttggattttaaaatcggggtggagccaaaggattccccgccctttacagtcatcctagtggcctcgtccagacaggagaaggcagcgtggaccagtgacatcagccagtgtgtggataacatccgatgcaatgggctcatgatgaacgcatttgaagaaaattccaaggtcactgtgccgcagatgatcaagtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaa

SEQ ID NO: 174363 - DNA, 8167 bp, Homo sapiens
  Payload ID: 14221
  Gene Symbol: RASGRF2
  Gene Name: Ras protein-specific guanine nucleotide-releasing factor 2
  Uniprot ID: O14827
  ENST ID: ENST00000265080
  CDS Start-End: 68-3781
agctgggccatggccgcgaggcaggggtgagaccggcggccacccgtgagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatcatctctgcaccttgctttgtttgttttctttccccactcatagtactgcaggaatctattctcatttacacagacctttttttaggcttactatgaacattggctgtattttttttaaacagtttagtgaaattttcttttcaaaacccacacttccatatgctgttcgtagatctctttctttaaaaactgatgttgagagatctctgagaatattataagtgcatgggaaatgggcccaaccaccgaacagctcttacattacaaaaccaaatgcaagggttagtcctgctacctgaggctggggaagtgaccttccttttcccaagattgtcagttgttgaagaaatagggctatctcattgtttacctccctcttctcttctcagggagactgctgctttaaaagaaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaaccgggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtgaatagtaatccctgtgctgcttatctcacagggctattgtgaggaccaaatggattagactgtaaactgcaaagtgctgtccgcacatgaggtcatctgattactgtcctcagatctcttttgtagaggatttcaatgtatttctttatcatttgagtgtgtgtgtgatggacgaatatgtgtgtgagtttgagaagcatatcgttcgtgtccagttactttgcaaatttgtggacatttgtgattggacagaggggtttgtgctgtggcctaacacttgccaagtgaggtgtaggttatgcctatatgcaaattaaacttcacctttcttgaa

SEQ ID NO: 174364 - DNA, 3837 bp, Homo sapiens
  Payload ID: 14221
  Gene Symbol: RASGRF2
  Gene Name: Ras protein-specific guanine nucleotide-releasing factor 2
  ENST ID: ENST00000503795
  CDS Start-End: 51-3506
gaggcaggggtgagaccggcggccacccgtgagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattcatcaaggctgaatacttgatttaaagagttgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaa

SEQ ID NO: 174365 - DNA, 7440 bp, Homo sapiens
  Payload ID: 14222
  Gene Symbol: RREB1
  Gene Name: ras responsive element binding protein 1
  Uniprot ID: Q92766
  ENST ID: ENST00000349384
  CDS Start-End: 315-5378
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttgggg

SEQ ID NO: 174366 - DNA, 5789 bp, Homo sapiens
  Payload ID: 14222
  Gene Symbol: RREB1
  Gene Name: ras responsive element binding protein 1
  Uniprot ID: Q92766
  ENST ID: ENST00000334984
  CDS Start-End: 315-4745
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaagggg

SEQ ID NO: 174367 - DNA, 5826 bp, Homo sapiens
  Payload ID: 14222
  Gene Symbol: RREB1
  Gene Name: ras responsive element binding protein 1
  Uniprot ID: Q92766
  ENST ID: ENST00000379933
  CDS Start-End: 457-5520
cgggatggcaactgcggtcaccctgctaaagtcggggcgggggcggcggtcctccccctcaccccccccagtccgagcgccgccgccgccgccgccgccgccgccgcggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatg

SEQ ID NO: 174368 - DNA, 8778 bp, Homo sapiens
  Payload ID: 14222
  Gene Symbol: RREB1
  Gene Name: ras responsive element binding protein 1
  Uniprot ID: Q92766
  ENST ID: ENST00000379938
  CDS Start-End: 538-5766
gaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttttttttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 174369 - DNA, 2833 bp, Homo sapiens
  Payload ID: 14222
  Gene Symbol: RREB1
  Gene Name: ras responsive element binding protein 1
  ENST ID: ENST00000483150
  CDS Start-End: 500-2833
ttcagacacctgagagcatcctgttctgggtacagtgtgtgtatgtatatgtttgtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgc

SEQ ID NO: 174370 - DNA, 1021 bp, Homo sapiens
  Payload ID: 14222
  Gene Symbol: RREB1
  Gene Name: ras responsive element binding protein 1
  ENST ID: ENST00000471433
  CDS Start-End: 529-1021
gggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgtaagttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaac

SEQ ID NO: 174371 - DNA, 998 bp, Homo sapiens
  Payload ID: 14222
  Gene Symbol: RREB1
  Gene Name: ras responsive element binding protein 1
  ENST ID: ENST00000491191
  CDS Start-End: 590-998
gcgggcgaggaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggaggtaatcagcagtgtggcgggagggttcttctttccctcctaggttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccacca

SEQ ID NO: 174372 - DNA, 243 bp, Homo sapiens
  Payload ID: 14222
  Gene Symbol: RREB1
  Gene Name: ras responsive element binding protein 1
  ENST ID: ENST00000467782
  CDS Start-End: 232-243
gcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagagttttatagcagaggcttcttagaagcttaaacccctgtcccaatgacgtcaagt

SEQ ID NO: 174373 - DNA, 3563 bp, Homo sapiens
  Payload ID: 14222
  Gene Symbol: RREB1
  Gene Name: ras responsive element binding protein 1
  ENST ID: ENST00000611109
  CDS Start-End: 252-2519
gtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcagggccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaagggg

SEQ ID NO: 174374 - DNA, 3834 bp, Homo sapiens
  Payload ID: 14223
  Gene Symbol: RSU1
  Gene Name: Ras suppressor protein 1
  Uniprot ID: Q15404
  ENST ID: ENST00000345264
  CDS Start-End: 218-1051
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaaa

SEQ ID NO: 174375 - DNA, 3919 bp, Homo sapiens
  Payload ID: 14223
  Gene Symbol: RSU1
  Gene Name: Ras suppressor protein 1
  Uniprot ID: Q15404
  ENST ID: ENST00000377921
  CDS Start-End: 303-1136
gggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaaa

SEQ ID NO: 174376 - DNA, 3639 bp, Homo sapiens
  Payload ID: 14223
  Gene Symbol: RSU1
  Gene Name: Ras suppressor protein 1
  Uniprot ID: Q15404
  ENST ID: ENST00000602389
  CDS Start-End: 191-865
gctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttc

SEQ ID NO: 174377 - DNA, 1746 bp, Homo sapiens
  Payload ID: 14224
  Gene Symbol: RASD1
  Gene Name: RAS, dexamethasone-induced 1
  Uniprot ID: Q9Y272
  ENST ID: ENST00000225688
  CDS Start-End: 213-1058
agcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccaaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtctgaggtctttaaagttattgctttatttggttttttaatatacaataaaataatttaaaatggaaaa

SEQ ID NO: 174378 - DNA, 1404 bp, Homo sapiens
  Payload ID: 14224
  Gene Symbol: RASD1
  Gene Name: RAS, dexamethasone-induced 1
  Uniprot ID: Q9Y272
  ENST ID: ENST00000579152
  CDS Start-End: 215-583
agagcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattc

SEQ ID NO: 174379 - DNA, 3412 bp, Homo sapiens
  Payload ID: 14225
  Gene Symbol: RASD2
  Gene Name: RASD family, member 2
  Uniprot ID: Q96D21
  ENST ID: ENST00000216127
  CDS Start-End: 643-1443
gcgcggggagaaagaagccgtccctccggcgctgggagagctgcagagccgcgggcagagaaggaggccgcggccgagcccggcagcccgataccccccatccgagcgaccccctttggggcaggcggagaaggtggcataggcgaccaggagggttcgcccacctgggacacgcacccacagtcacctccaaaggaccccccctccccaagtctctaggagctgctccttcatcactggagtcgcccctacctctctgcccccagcccgagagccccaggcggggacccccggatcggacgtccccaagcctccgggcacctggctcagcaggaggcccccggctcggggcagggcagggccggcggcggcgagccggagcccgccccctgcccgggccccgccgagccctcggagcccacccatggggcacctgccccttgcgcctccttgcccggccgcgcccagcccggcgtcccgagcagcgcaggggaggatccccgcgcagtgacccgggagccaccacagactctgggaggctcggcggctggagcagcaggcagctccccgcagctcccggcgcttccaggcagctctctgagccgtgccagaggcccggcccgccattcccagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaagc

SEQ ID NO: 174380 - DNA, 632 bp, Homo sapiens
  Payload ID: 14226
  Gene Symbol: RASGEF1A
  Gene Name: RasGEF domain family, member 1A
  ENST ID: ENST00000374455
  CDS Start-End: 1-632
aagctgcagagttgcgggctgggtggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaact

SEQ ID NO: 174381 - DNA, 3264 bp, Homo sapiens
  Payload ID: 14226
  Gene Symbol: RASGEF1A
  Gene Name: RasGEF domain family, member 1A
  Uniprot ID: Q8N9B8
  ENST ID: ENST00000374459
  CDS Start-End: 86-1555
ggtgcttgcttggctcgcgggcagaggagccgccgctcgctggacgccggaccgggcaggacggcgcggggagccggcggccagaatgttcctggagccccaggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactcccc

SEQ ID NO: 174382 - DNA, 4104 bp, Homo sapiens
  Payload ID: 14226
  Gene Symbol: RASGEF1A
  Gene Name: RasGEF domain family, member 1A
  Uniprot ID: Q8N9B8
  ENST ID: ENST00000395809
  CDS Start-End: 2508-3953
tcatgatggctattgctgtgactggagccaagagcccagtgtgcaattcttccttgggaaggggctgcctggtggtggacacagctgttcagatacacaggtttgcagctgcctgtcgaagtgcctgcccctgctgttggggcaaggaggaagcaggtgcaagaacaagcgacctcagggctgggtgggggtggccggcaggggaccccgcagtggaagtgctgtcatcatcaccatttcacagctgggaaggtggagggctggccagatgcacccaggaacaaggagtgggcctgctgcagggccggcattcctgcccgggaaaagccatgtagggaacctgcctctccacttggcactgagccctggagaccctcctcgaagtgctccgtggctgggcagggtgggccctgctaggtttgagctttcgggggtaggggctcatggggcatcccccagacctgcagggtcttggtttgttggatgcaggagacctagccctgggccgtgtccccaggtgggtctccaggtaggcaggacagaaggaacccagagcaccccacctctcaggtcagtgcggctccacacggtccccctcaggctctgctgactccccaaagggattctgagcatgtgcagaacctctgcttgcctgggacacccctgcatgctcctcctccaggcccccaccctcgaaggcgtggccttcccagcccctctctggctgctgaccagtgggctgggtccccaggatggctcctcaactcctaggcaggcctcctagcactgaggcaggtctctctgcaggctggacatggagtggccttgccctgtgggggatcggctggggctgagtttgtggggtgtcagagtgcatcccccacatactacctcctgaccagagcagcctgcagtgggagaggccagtggctcggcaaatgccctctctgatgaccccaagagcttggggtgaggaggcccaactgaccaaggttaccacctgctggtcgccttttgaacccagaactgtgtgatcttggggaggttgtcccacagtgcattggcctcagatgcctgagacagtgctgagcagctgtgggcaacaaggggtttgtgagcccgccttcgtgacttcattgcacaaatggtcactgagtgccaccctgggccagcgataggatacacaggtgaatgatacagccacttctggctttgtgggtcaacagtctaggttaaacccagggaggcttcctggaggtggtgacacctaggctggacttggaactcctggggtttccttagttgagttccttcccactgggcctcagtttcaccatctgaaaaatgaaggattggctcacatcagtggttcctgggctggagtggagagcgcgttggggtacagaagcagtccaccccagagtttctgaccagcaggtctggggctaggcctgagaatgtgcattctaacttgtgtgaggcaccgctgctggcctgagtttgaagggagcattgtatgagtctgagccatgacctccctgtcctggagtgggggcagcactgagcctgggggcctggacattccacccagcgtcatcgtggggcctttggttgcgttcttgctctccttgccaaagactttctaagaattccaaggaaacctttaggtgtttggtgggaaaaccagtgacgtctgggccagatgctcttttttccctggtgggagggacagggacgtgctgtgtgtgtgtgtgtgtgtgtgtgtgtgtgtgtgtgtgtgtgtgtgtgtgtgttgacgtggggggtgtgggcaggtggtccgctctctccttgtaaggcccctacagggcagaggcccacggtcctgtcatggcactgaagtaatcatggcaacaatttgctctgtgcagtggggaaactaaggccaaaatggcaggagggtctcgcttctccacctgacctcagccgctggcacctgtgctgccttcccttgagggccaggaggttgaggctggctctgtgtgcaggcaaggccacaggcaggccacctctggccctcaggctggcagttgctgcatcgtccagtccccacttggctcctcccaggcatggctggctgtctggggcactggggaaacaggcccagagggcttcagactcccctaggcttcacaagaactcccagctgcagggtgtggtgagaccctgagccccatcacagcgggccatgctgtggaggacagtcccagtgtgggcaccgaggcctccaggaggcccagctgctcagacatctgcagctcaggggcactcagactcacaggccccaaagccagttccagatctctctctagccctgcccacagccctgcctcatactggtcagccacttggcccaagaccttcaccatgtggagtggccctgctcgccactcctgctaccgcctgcctgagcaagctctccttgggctgtggcaagacccaccatccacgtggcagccaccgaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatc

SEQ ID NO: 174383 - DNA, 3235 bp, Homo sapiens
  Payload ID: 14226
  Gene Symbol: RASGEF1A
  Gene Name: RasGEF domain family, member 1A
  Uniprot ID: Q8N9B8
  ENST ID: ENST00000395810
  CDS Start-End: 82-1527
ggcgccggccgcgcgctgctcggggcccgactgcggcgcgagggcggcgcgggagcgacgctggcccggaccgaggaaactatgccccagacgtccgttgtcttctccagcatccttgggcccagctgtagcggacaggtgcagcctggcatgggggagcgtggaggcggggccggtggcggctccggggacctcatcttccaagatggacacctcatctctgggtccctggaggccctgatggagcaccttgttcccacggtggactattaccccgataggacgtacatcttcacctttctcctgagctcccgggtctttatgccccctcatgacctgctggcccgcgtggggcagatctgcgtggagcagaagcagcagctggaagccgggcctgaaaaggccaagctgaagtctttctcagccaagatcgtgcagctcctgaaggagtggaccgaggccttcccctatgacttccaggatgagaaggccatggccgagctgaaagccatcacacaccgtgtcacccagtgtgatgaggagaatggcacagtgaagaaggccattgcccagatgacacagagcctgttgctgtccttggctgcccggagccagctccaggaactgcgagagaagctccggccaccggctgtagacaaggggcccatcctcaagaccaagccaccagccgcccagaaggacatcctgggcgtgtgctgcgaccccctggtgctggcccagcagctgactcacattgagctggacagggtcagcagcatttaccctgaggacttgatgcagatcgtcagccacatggactccttggacaaccacaggtgccgaggggacctgaccaagacctacagcctggaggcctatgacaactggttcaactgcctgagcatgctggtggccactgaggtgtgccgggtggtgaagaagaaacaccggacccgcatgttggagttcttcattgatgtggcccgggagtgcttcaacatcgggaacttcaactccatgatggccatcatctctggcatgaacctcagtcctgtggcaaggctgaagaaaacttggtccaaggtcaagacagccaagtttgatgtcttggagcatcacatggacccgtccagcaacttctgcaactaccgtacagccctgcagggggccacgcagaggtcccagatggccaacagcagccgtgaaaagatcgtcatccctgtgttcaacctcttcgttaaggacatctacttcctgcacaaaatccataccaaccacctgcccaacgggcacattaactttaagaaattctgggagatctccagacagatccatgagttcatgacatggacacaggtagagtgtcctttcgagaaggacaagaagattcagagttacctgctcacggcgcccatctacagcgaggaagctctcttcgtcgcctcctttgaaagtgagggtcccgagaaccacatggaaaaagacagctggaagaccctcaggaccacccttctgaacagagcctgaggcggatgcagcccgcgacgccagaggaagcacgtgcactaactgggtttaaattttgactgatgtgggttgagatgaggaggcctcactggttggggtccattttgtatataacttttatgagaaaaaaatggtaattatttcacgcatcaacctttggcacttacaaagttttttttgtttattttaaataacagggcagggccctgctttggggagggggaggggagagtatcatgggagatggtatccatgataacatcttattctaatgaaatgtagatttttattttctacttttgattattaacatcttatgaaaaaaatattttaaaaaacccagccaaaaccaacgtgagccctgcctgctcggacgcctttccagccagtgtctctgacgtcggggttagtgccttagagggtactggggtctggtcttcctgctctgtggtttgggctgcggtgagtcccactccacctgggcgcctgccctcaggagcctgggctgcgaggctccataggagggctggtggctgggaggtcgcgtccgcacacttctggaagtgagcctttgagtacgggctgtccaaagtttacattttcattttcctttcagggatttgtggggtcagggaggggcagggggcacctggcagcatattttctgtgacaatgtgtccagcaaatcattcttcaactacattttagaaaggaggaaatctaaaataaggtaagggagggaagcatggagttgtcagttttctgggctgtgactgaaagacacactgagctgtgatgaagaaaaatacatggccgactccagggtggtgacatttagagctagtcttgaaacctatcatctacagaggggagggcagccaacagccctcttcccacctgggtaggcagcgccctaattggaattggaaacagaaaattcgccaggccatactgctggagcccattcagataaaactgcccaatactgagaggtgttttctacacccagctagaggagcacactccattttcccatgtctgacttcgtggtgtgagccctgggccctactgaccatggcgcaggacagctgtccttcagaaagcacacggtcaatccacgtggaccgtctccctcgcaggaactccgcatccttgtccctctgcattcccagtttccgcaggagccttgatcaatggggaagcctgggtgaggatgggccaggtcccaattcccaaagctcctggaagagcctgaagacattgggaaaggctgggcctggggaggaggcagccctgggcccgctgcccatgcctctggtcctgggtggagcaggaatagttccactgtattgtcacagtgtgtttgcactttctgaggttctagctagtacagattgtatattgatagtacatattgctttgtttatgtctttgagatgagaaaggcttaaaacttgagaatatatatttggaatacagccttagaacggtttctgtacacacccacgtgcacttcacgggtgatcagttctagtacctacttgaaacagtgtctgtctgctactttattttcccaatttgatacataccctgatttgatgttttggtatttgagatgaactctgagtatgaagctgtaccataatgcaggacgtcagttttggtgtgactggacatacttgcttcaataaaagaatacatcactccc

SEQ ID NO: 174384 - DNA, 2277 bp, Homo sapiens
  Payload ID: 14227
  Gene Symbol: RASGEF1B
  Gene Name: RasGEF domain family, member 1B
  Uniprot ID: Q0VAM2
  ENST ID: ENST00000264400
  CDS Start-End: 153-1574
gtagtttcagtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 174385 - DNA, 1756 bp, Homo sapiens
  Payload ID: 14227
  Gene Symbol: RASGEF1B
  Gene Name: RasGEF domain family, member 1B
  Uniprot ID: Q0VAM2
  ENST ID: ENST00000335927
  CDS Start-End: 142-1437
ataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagataaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatgga

SEQ ID NO: 174386 - DNA, 6323 bp, Homo sapiens
  Payload ID: 14227
  Gene Symbol: RASGEF1B
  Gene Name: RasGEF domain family, member 1B
  ENST ID: ENST00000436139
  CDS Start-End: 128-760
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactggccttggcctcccaaagtgctggaattacaggtgtgagtcactgcacccagccgcaattttttgtgagaaaaggggaagtatattaattgttgagggaattaagtgaaaaatttaaaaaccttcatctgaagaactttggggctatgttcatgtcagctcatgcacaggatttatgttgcaagtgtgttttaattttactttacttatacctttttacttccaaaaaggtttgacacagctagttagatgataataagtggcatcttaatagatataaacattttaatgccatttatcccaattttacaaaatcagactaaaattatgtaaggctagcttttgaaaaatttgtatgggctttcctgtattatgttctcatgaaaatgggattaaccattttactgttactttttgacattatattatgatgaacccaagtgctcgagacagccattatttctgccgggccgaatgagtcatttcctgagtcactgtgcaagttatgacggttataatcattttgccagtttgcctcttacaggttctagccaggtatgaattgataggtcccttgcttacaaaggcaaaagttaagcatcatggtgcagttttgtagtaaatcttatgttagaggggttagccgtggagttccttggcagggtcagtgctggctcagtgaccttggtttatgtatctgaagctgctcaaaagatcagtgacatcataagggctttttcttgtatgaaggctgagacctaagtcaaacagttttcatttcagtttggttgtctttagctacttaacattatatgtcagtcatcttatcttccctctattgcctttataacttagttctttccaaaagaaacaccttaaaaatctttttcttttaagataaaatgttggcattttgaaaataccaaatggatggtccttgttgttgcggcagtcaaaggggagatcatttttatttgtgtttacctgatgagaattggtctttttgtttaacagaatcaagccattcgagagctgggtagaacagagagaagggccaaacagccttgtgaccctggcttcttttcaacactcctgggttaataacatattcttgatagaaaccttgcgaagttcagatggttttgagcatgaaaagaggagataagaagacaagccagttctaactgaggaattgattaaactaagggttgagtggagagatgtcacctgccttgatcgggttgggtttcacagggagatgttgtttctttagctgcttctattcagtattcagaattcaaatccacacttgccagctggtttatctgagtgtgttttggctagtcctctaaatccttgctcctttctcatctctataaatcacagaagtaactgccttgtgttaatgccctttcagctctgaaactgtgtgatcgatgtccttcctccagttctttggcttcaggctccttatcagtcacgtgcttaggtggctctcctcagagagaccttcccttggcacccaactatgatcataccccctcccattatgggctttcactgctcttcccttcatagtcattcttagcactctgtgatgagtaatgatagctggccctctctctgtatttgtgggatctgcatccatgggttcaaccaacctcagattgaaaatattcaaaaaatattaagtctgtactgaacacatatagactttttttccttgtcattattccctaaacaatacagtatcacagtgatttacatagcatttacgttgcgttagctattataagtaatgtagagatgatttaaagtatacaggaggatgtgcggatgttgtatgaaaatactgtaccatcttagagcggagacttgaccatctgcagattttagaatcccagggaagtcctggaaccaatctcccgaggatactgagggatgactgtacttgcatttttattgcttgttttcccctctagaccccatgctgtgccctctttgttcaccacggcatccttaactcctagctcagtacctggcacctagtattctctcagtagtgtttgaatgaatgagtcaatcaatgaatgaatgaacaaatgaattactggaatagggaaaaattatttccctctattggaaggaatatgggtctgggttgggatttgttgcttcttgcctgggacttttttttttttttttctccttttggcagtcagtgaatccaggtgtgccgtatatataatttagtcaggttcttctgaatctaccaggacagttctacataatttggcataatatgtttctcccctggggatttgcccaaaatgaagtggtttattaggacttgcctgcaagaaacatgaaatgaaactaatgattgaattacatgacaaatgactgtagtgagtagaatgcaattttctcttccttaaggggctggtctttataataagagcttctatctttatttgccaggtaattactgtcactggcatttgaagttataaaaaagaataagtacatatttagtaattcatgactcagtgaggaaccatgcttaacaacacaaagcttgatttctcaaatggaatcaactggcagcaggaaacttttaaaagaggtcatatacatacactctctcacatgctcacacactagttgttgttgaatagctttcccccatactctattgcatacatttttcccttatattttgatgcagttttttgctaacaacctgattatacattcctctgcctcttcccccagtaaatttttctaaaattgcggaataggctgggtgcggtggctcatgcctgtaatcccagcactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggta

SEQ ID NO: 174387 - DNA, 3016 bp, Homo sapiens
  Payload ID: 14227
  Gene Symbol: RASGEF1B
  Gene Name: RasGEF domain family, member 1B
  Uniprot ID: Q0VAM2
  ENST ID: ENST00000509081
  CDS Start-End: 223-1641
gtttatttttgttgtcagtgccatgtaatctaaagtctgactcgtaggaagggacaagggaacagaagtcacatactcgccaccgacaaggtgatgtgctgtcatccttcggtgttcacctggcaaacttgggagacactgagtcgccttgcttttgccagagctcagttgagtcgcctcgggtcacctgcctggggaatctcagatgagctagaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacactcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaatcagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactagaaagaaaataaaaagcagagtttgtcattggactgcttaacatgctagaaggactttttttttttttttttttttttttttttgctcttctgagctgtttacaactgaccactgtgttccacagatgtatttttcaatagctttttgttacttagttttccatgatgcctgttatttttctcttgtaaatttaaatgagctgactttaaggatcttgggaaaacccatggcataattacaattttctttttaatcgacttttcattacttttgggagtctgttggtaactaaagatgtcaacaaagaataaattggagaagttacctgtccccactatagcagtaaacaaaacagatgaaaaacaccttgctgttaactcaatggttgatctaattgtgaaatcgttcaccttgttaaacatctaagtaagtctgtagtcgctctgcaaacagccattatatttatttactctagaagaaactgtagagtagtaattcgtgctaatgagaaaaacaaaataccatgttcaaaacagatgtatttgaaaacttaatgacatggttccaaaaactagagcatgtatgtatgctgtgcatcatctcagcagacctaaaatatccccaagttgtccctttacagccatcaatatattttacactctgcggccagga

SEQ ID NO: 174388 - DNA, 860 bp, Homo sapiens
  Payload ID: 14227
  Gene Symbol: RASGEF1B
  Gene Name: RasGEF domain family, member 1B
  ENST ID: ENST00000504863
  CDS Start-End: 163-860
agtataaacaaggaacccgactggttagacagattttgtttttcttcttcccgcgcgctttagctccctgtcctttggtcgcatttgtgggcgcgcggcacgcagccgggaggccgaggactcggagttcacctgcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttg

SEQ ID NO: 174389 - DNA, 516 bp, Homo sapiens
  Payload ID: 14227
  Gene Symbol: RASGEF1B
  Gene Name: RasGEF domain family, member 1B
  ENST ID: ENST00000512716
  CDS Start-End: 487-516
gcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgagtctaaaagtcattcccgagttggcctgaaatcaagcaccaagcaaaagaccaccattttcagcacattggccagtgagaagtccttatctgactgcaaaaagataattgaaccagggcacaaggagacttttgtacttgttcaggtcacacagtaagtgatggagccaggattacaacctgcccttccttacaacctgctcttccttacaacctctgacaccatattctgaaagaggaaagtatgcctcagactcctcccttttcagcaatg

SEQ ID NO: 174390 - DNA, 3485 bp, Homo sapiens
  Payload ID: 14227
  Gene Symbol: RASGEF1B
  Gene Name: RasGEF domain family, member 1B
  ENST ID: ENST00000613784
  CDS Start-End: 128-760
cgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagaggttggtaacctgaatttagcgcggctgctggaattcccaggcagagcctgggtgggaaatggtgccgaattatgcatcctaatctccactgcttcctctctgttttgcctttgggcaagccctccacatcacatattggtctatttagtatgtcaagtgagaatgattataccatcccacttcaaagggatatgatctagagttttatgtgattaatttggggctatgttcatgtcaactcatgcacaggatttatgttgcaagtatgttttaattttactttacttttaccttttttcctcccaaaaaggtttgacacagctagttagatgataaatggcatgttagtagacataaacactagtggatacaaagtaaataacattattctattaaccgaggataaatagtagattaataaatcataaatagaaatagacattctgggccatggcagaaagaaaataaatacgctcctgttgagaatgagtagaggaggacaggactgctgtggtatgagtttaagttccaggtaaaagggaaatacagctggtcatgtaatattcactgtcagaaaaggggaagtatagtaattattgagggacttaaatgaaaaatttagaaactttcttctgaagaactttgtatagggtcatagaatgagatcctacaaactgctctttatggtgtttacaacataccttcctggatagaagctgagttcatagattcatgtgtaaattagcaaagataattcttgggggaggagaagactgagaaaatgaggcaagtcttccagtgctcagaagttgatttaaggatagactctagtataggtagagattaaaagtaagtctcttagataggctttcataaatatcacttccctcagttgagcctttgataagcactaactactagctgtgacaaattcaaggttatcctttttgaagcaggaccagagggctggtattctgtgttgagacttgctgggcaaggatgcccttgtagtttccatgttgcaggtcaacttctgggaacaagtcattcaggcacagatacactttcacctggaaaaagtagatgaagcatttggcaatgatgttgcattttattcgtcttaaaatgcattttccattatgaataaccttccttgagaactctttcagtggtgtgctgcaacgtataacttgataccctatcctttttttctgagacagagccttgctctgttcctcaggctagagtgtagagttgcgatcatggctcactgcatccttgacttctctggcttaatcaatcctcccacctcagcttccctagtagctgggactacaggtgcatgcaactgtgcctggctcgttttttctattttttgtagagacaaagcctcactatgttgcccaggctggtctccaacttttgggctcaagcaatccactttgggaggctgaagcaggcagatcacctgaagtcgggagttcaagaccagcctgaccaccatggagaaaccccatttctaccaaagatacacaattagccaggtgtggtggtgcatgcctataatcccagctacttgggaggctgaggcaggagaattgcttgaacccgggaggcagaaattgtggtgagccaagatcgtgccattgcactccagcctgggcaacaagagtgaaactccgcctcaagaaaaaagaattgcaaaataaaaatctttcagcagatatgctggtaaagcattgcttctcacacttggcttatacaaggatcagctgaggagcatccagagcatgtgacacaagtgcactgcagaccaagtcgatcagaatctctggggtggaacccaggctgcccccattcagcggttctgctcattgcttcccagcaggtacccttgtgtggtaccctgaatagaagtggtaatttcttactaaagtattttctgcagggatcccgggaaggggtgaggagaaggtgcatgatgtaggaatgataacatgcatggaatagcagctgaggcatagaataataaatatttttaaatgagttgttggcttttttaagtgaaaagaactttcttgtgcatgtctcatgcctgtgttatccaaaaaatcccattctgtgggaaaattttaaaacattttatttttaatatatcaagtaatataggaatatattcacttagattttgtttaaaaagaattcatacaaagcaaaagaggccaaaaaactccattcaatccagcttctctcttaaaggtaacaagtgttgtcaattttgtgtgtatccttccggcgctgctcctatgtatacaggtgttcacagaaagtagtgtgtatggcttttgtttccatgtatgtttacctagtattcatcaccctgcttgttttctctgtgttatgtcttggaaacccttccatgtcaatgtaggtagctgtatcttctttcagctgctatacagtagtccagtatgtgattgggccatgtttctttttctttttaaaaactattctattggacacaaacaagttaaatttgtttatactgaaaactcaggcgttttctgagaaagacttagcaaagaagattaagtcccttcttcatatcaaactctgtttagtaaagtagtaacatatagttgtgggttgctcttgtaaacaggctttactgactgtgaaacttcaactttgtaacatgtattttctactctgcacttgatcttagccaaaagggtgagaagcgattctaccctggatagtatatgctgtaattaagtatctccaagaaggtgtttattagccattctgagtaatacactgggaaatatttgcataattattagaagtagtatctaactctcatgtagtcatttgttatgacattttggacaaaggactgaataaaacattttaagttggt

SEQ ID NO: 174391 - DNA, 2243 bp, Homo sapiens
  Payload ID: 14228
  Gene Symbol: RASGEF1C
  Gene Name: RasGEF domain family, member 1C
  Uniprot ID: Q8N431
  ENST ID: ENST00000361132
  CDS Start-End: 133-1533
cgggcggcggcggcggcggcggcggcggcggcggcggcggcgggcggcgccccggtccgcggcgccgaggctcgcaccgggagctgcccatgggccgggcccggagttccggcgcgccgggagccggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacacacccgtacgcctatcca

SEQ ID NO: 174392 - DNA, 2395 bp, Homo sapiens
  Payload ID: 14228
  Gene Symbol: RASGEF1C
  Gene Name: RasGEF domain family, member 1C
  Uniprot ID: Q8N431
  ENST ID: ENST00000393371
  CDS Start-End: 298-1698
ggggggaagaatctagaagaggcctgcccctgagtggggcaagaggagtagacaagagatgggtcctgcaggagagttgagaggccatgagaagacggagaatgaaggctgtgctgtgaggaaggggccctgacaatactcccaggaagtgaccactggactcaagctggcacaaagtggctgtggggggagcctgcccagccaggagccccgggaccagcagctcccactcaggtgcacccaactcaggtgtgcccccactcaggtcctcactgctccttgccattgcaggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacacaccc

SEQ ID NO: 174393 - DNA, 2055 bp, Homo sapiens
  Payload ID: 14228
  Gene Symbol: RASGEF1C
  Gene Name: RasGEF domain family, member 1C
  Uniprot ID: Q8N431
  ENST ID: ENST00000522500
  CDS Start-End: 415-1362
agcgcgaagactcaccagggaggatggagccgtcaaccgcagaaaggccagagcaagagatggccctgcccagaaatgtgtccgtcccccctcctctccccgtgggcgcagagcaggatcgcacccccctcctcctccctggcacagagagggcacgaggccctgcctgccccgggcggccagacccgcaaggacgcgcagtgaggctcacgtgcccacccggcgcccctcacgagcgcggtgcccctcgcttgcccgtaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacac

SEQ ID NO: 174394 - DNA, 1892 bp, Homo sapiens
  Payload ID: 14228
  Gene Symbol: RASGEF1C
  Gene Name: RasGEF domain family, member 1C
  ENST ID: ENST00000520209
  CDS Start-End: 217-933
cagtgaggctcacgtgcccacccggcgcccctcacgagcgcggtgcccctcgcttgcccgtaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaaggaggccaccttgggaggccgaggcgagcagatcacaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaa

SEQ ID NO: 174395 - DNA, 2268 bp, Homo sapiens
  Payload ID: 14228
  Gene Symbol: RASGEF1C
  Gene Name: RasGEF domain family, member 1C
  ENST ID: ENST00000615330
  CDS Start-End: 578-1294
ggcggcggcggcggcggcggcggcggcggcggcgggcggcgccccggtccgcggcgccgaggctcgcaccgggagctgcccatgggccgggcccggagttccggcgcgccgggagccggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccaggggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaaggaggccaccttgggaggccgaggcgagcagatcacaagattgtcattcctttcttcagcctgctcatcaaagacatctacttcctgaatgagggctgcgccaaccgccttcccaatggacacgtcaactttgagaaattcctggagctggccaagcaggtgggggagttcatcacctggaaacaagtggagtgtcccttcgagcaagacgccagcatcacccactacctgtacaccgcccccatcttcagtgaggatggtctttatttggcttcttacgaaagtgagagcccagagaaccaaacagaaaaagaaagatggaaagctctaagatcttctattttggggaagacatgaaagcgctgagctgagggacgaggaagagctggagcccgcagaagccgtccacagccctgcctcagtggcccagtgggcagaggccagggagtgcctcactattttgcaaatgccgaccctgtggcctgctgcccgccccccccccccccacagtggccatacgggcacaggagaccttttatgggactttggccctggcaggacccagggcctccagacgtgcgggcggcacatgccttggggacatcctgccttcaggaccgtggggcctggtcagtctgtccatcctcggcaaggacacaacactgccccagagggtgggaccactgcaagctcgagaccttgcttggtgacatgtgccactttggccaccacccacagtctgtcaccacgtggcttgggaacttctggagccacagcaggcatcacggtgcgacgtgagatgcctgcgccagccccgagcccactggcagccactgccattccacccatggtccctcaccctgccctgccgacgagcttgtctctgcagccccaggtacccccttcctggatgctgctggccccaggagatagctttccggtgacagctgtggaacgcgtcaacaggacaaactggacacatggagttacagtgtgtacacggcagtcccgccacccagcccccttgtaaactctagtcactataaacacacccgtacgcct

SEQ ID NO: 174396 - DNA, 855 bp, Homo sapiens
  Payload ID: 14229
  Gene Symbol: RIT1
  Gene Name: Ras-like without CAAX 1
  Uniprot ID: Q92963
  ENST ID: ENST00000368322
  CDS Start-End: 31-741
ccagagtaagagggacaggccagaatatgtatggaaaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatg

SEQ ID NO: 174397 - DNA, 3445 bp, Homo sapiens
  Payload ID: 14229
  Gene Symbol: RIT1
  Gene Name: Ras-like without CAAX 1
  Uniprot ID: Q92963
  ENST ID: ENST00000368323
  CDS Start-End: 206-865
gcgactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggagaatatgtataccatgtgtgtttgactaagttcacaagggaagtttttggctctgcactccacattatcctttaatttcaatttcctgggactatcccagagaaagacctcagtctcttctattcacactatgcttcctagagacagaacaaaaatcatgtagggaaattggggctaatgagatcagtgccaaatttcagcagatacctgtgaggctgacacctgttgcagactatggagtggtgagatttgggaaagttgggctatatgtttgcagggacttaaaaaggtaggttcagaacagtattctcagtacaagcttcgcttttctaagaagtacacatttggcccaaattcaccgggataagtgagaacagccagaagcataaaatgtgatgaaggtttctcctgggaaccttattttactcttcatttcagggttttctttttttttttaccttcaaaggtagacattttgggaatcataactgtattactaaacgtgtttaatcaaaattcatagttggatcagccattgccttgtacaggtttattttttccccacagacgcacacaccaacacatttatattcattgcttcctcccactttgtgctctgtaaaagagctacagctggcaagatgttttttcggcccttcatcactgattgcattttccatacagaagagacatcaggggtgtgggtaaaattgtgtgtgtgcctccttgacgtggacaatcactagactcagtgctctgagaaaatctgctatttctgttgaatgggtcagtcttaaagctttaaaattcacataggtggagtttcccatctgaagatttctttacaaggactttgctaagttcatctcagggttatctgagccttgaccaagtttatcctaagggaataccactttgctccctgtgcatagtttaggaactgtagtcctaggaggaaacagctttaaatattggtagtgagttgtctaagatcaggactgttttgatatctgaccttgttatatgcggagagtaaatgcaaaaatgctaagagtaatgcatcatgtattgaatattaagtgtcactgaagcaatgtttgtgttgactagaaacgtaagatgacttgtgtagcacctctttataagcacacagctcatcttaatattttccatttttattagaggaagtaggacagagttgtgtttttctttataaacaaatgataaactagcttttttaaaaagtgactgttagaacttttttagctctgagtagtggtccctttttaaactcctggaaacatttttgttaccaaataaatcatgttttatggtactcagccatccaaaagtgaaagacctagcatttgattctgtgcaggacacaaatctcacaggaactatagcactttggaaaagcatcaaagtagaaaagaaatacagtgcaattctattatgagaatgttttacatttaaactggtttagcaccttttaagtttaaagcccatagcttcttattactagtgacctagggaattgttattaacattaagagatatatatatatatatatatatatatttttttttttttttttttttttttttaaatagagatgaggtttcactatgttgcccaggctgatctcgaactcctaggctcaagcaatcctcccaatatgctgggattacaggcatgagccaccacctggcccaagcaagaaattgacactatatagttatttaaggtagtcaggcagtagaaacattgccagaaggatagaaaggaatttggattatatataaggaaaataacaaatcggtgtttttaagactatcactgtcatatattagatccttgtattagtccatccattaatattagttctattcgtggtgctaggtagcttgacaggtatgatatgcataagtcatagctctattcttagtgtcataaagtgtagctaatttataagctctaagtaatcagctttatctaatttgagggcattaaaattactgcctagaactttgagaagagaaaaattcagggataagttgaaaggcactggaactgttcatgtccataccagaccggtaaattataagatccagatgttagtgtctagaattagctgtttagaattcagaggggacatatgttttaactttgtcatatattagcaagaattggtctactgtgatgtttggggaggaggagggggggataatttttttaatgcacttgtatgtgaagacagtttgtatgacataatacaaaacttttaaacaa

SEQ ID NO: 174398 - DNA, 919 bp, Homo sapiens
  Payload ID: 14229
  Gene Symbol: RIT1
  Gene Name: Ras-like without CAAX 1
  Uniprot ID: Q92963
  ENST ID: ENST00000539040
  CDS Start-End: 163-714
gactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgagccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgctttta

SEQ ID NO: 174399 - DNA, 803 bp, Homo sapiens
  Payload ID: 14229
  Gene Symbol: RIT1
  Gene Name: Ras-like without CAAX 1
  ENST ID: ENST00000461050
  CDS Start-End: 146-424
cggagcctccgcgagtgaaggaagacgaagtgcgtgacccgaccggctgtggtgttccagtccccactgaccagtaggagcagcagggcgtcggcttgtgaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggatagcaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattc

SEQ ID NO: 174400 - DNA, 574 bp, Homo sapiens
  Payload ID: 14229
  Gene Symbol: RIT1
  Gene Name: Ras-like without CAAX 1
  ENST ID: ENST00000609492
  CDS Start-End: 121-574
aaaggtaaggcactggcttgagggctgtcgccgtggtgtctccatcctggattaagcatttcctcctccttttctaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggcct

SEQ ID NO: 174401 - DNA, 1092 bp, Homo sapiens
  Payload ID: 14230
  Gene Symbol: RIT2
  Gene Name: Ras-like without CAAX 2
  Uniprot ID: Q99578
  ENST ID: ENST00000326695
  CDS Start-End: 173-826
gttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 174402 - DNA, 870 bp, Homo sapiens
  Payload ID: 14230
  Gene Symbol: RIT2
  Gene Name: Ras-like without CAAX 2
  ENST ID: ENST00000590910
  CDS Start-End: 131-640
cgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccagctgtgtgactggctgaaacacagatgggaagtagagctgtgggaaatcagaagaactgaaaagcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcac

SEQ ID NO: 174403 - DNA, 1156 bp, Homo sapiens
  Payload ID: 14230
  Gene Symbol: RIT2
  Gene Name: Ras-like without CAAX 2
  Uniprot ID: Q99578
  ENST ID: ENST00000589109
  CDS Start-End: 173-634
gttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccagcctacactgaaagagtttggaagggaagaattctgatggttgaagctgcttcttttcatatttggtttctacagaagaaggcttgagtcttgcccaagaatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctcaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 174404 - DNA, 2264 bp, Homo sapiens
  Payload ID: 14231
  Gene Symbol: RERG
  Gene Name: RAS-like, estrogen-regulated, growth inhibitor
  Uniprot ID: Q96A58
  ENST ID: ENST00000256953
  CDS Start-End: 338-937
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 174405 - DNA, 2134 bp, Homo sapiens
  Payload ID: 14231
  Gene Symbol: RERG
  Gene Name: RAS-like, estrogen-regulated, growth inhibitor
  Uniprot ID: Q96A58
  ENST ID: ENST00000536465
  CDS Start-End: 242-841
attggagttgactaatatgaatgtatgttattcaacccaaagagacatgaagaggcccaaaagtgactctctccattgccccactgcatgtgtttgtacactgaatgcttacagatagatggtaaatgattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtga

SEQ ID NO: 174406 - DNA, 574 bp, Homo sapiens
  Payload ID: 14231
  Gene Symbol: RERG
  Gene Name: RAS-like, estrogen-regulated, growth inhibitor
  ENST ID: ENST00000545567
  CDS Start-End: 235-574
aaatgcgaaagaatgacagccaggtatatcatattcaaacttctcctcagaaattatgcaagcaagaaaagagtgaaatgaaatatctgaagcattttgacaaaaagaaaatccaccgacctagaattctataccctgaaaaattactcttcaaaagtgaaggataaattaagactttcttgggcaacaaaaattgaaggaatttgctgccaataaacctgccttgaaaaaaaaatgatacgatacattcttcagagaaggagaatgatacatctcagaaactggattgtacttaaagaaaggaagagcattacagaaaaaggtaattttaaagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 174407 - DNA, 655 bp, Homo sapiens
  Payload ID: 14231
  Gene Symbol: RERG
  Gene Name: RAS-like, estrogen-regulated, growth inhibitor
  ENST ID: ENST00000393736
  CDS Start-End: 540-655
ttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggaagaggtaaccatccatcacggttttcccagaacaggctgatttgcgtcttctgtcctggcataaggatcccttcactctcggaagtgttccggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccct

SEQ ID NO: 174408 - DNA, 2060 bp, Homo sapiens
  Payload ID: 14231
  Gene Symbol: RERG
  Gene Name: RAS-like, estrogen-regulated, growth inhibitor
  Uniprot ID: Q96A58
  ENST ID: ENST00000538313
  CDS Start-End: 141-740
gaattcccaaatttcttttgtttaaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcat

SEQ ID NO: 174409 - DNA, 935 bp, Homo sapiens
  Payload ID: 14231
  Gene Symbol: RERG
  Gene Name: RAS-like, estrogen-regulated, growth inhibitor
  ENST ID: ENST00000537647
  CDS Start-End: 327-539
gccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaaaatatttttctggatcaaataaaactgagaaatctatgctatgaacaaaaataaggcacttttcttcaactaacttttgcatgcctaaaacctttttctctaattaactagccattttatatattaacatatttgtaaatatctgtatattcatccttatataaactgcccagtgtttcaagggggttttgaaaatactataatattcacatatcatctaggttagactctctcacctatattttgtggcatagcaagatattaataagttttcatggtcaaatgtgttttgaaatgctcaaatgaagttaaacaggtgtctttactgaaagaattctcagagcctctaacaggcttgtgtgtgagtctttaagaaagagatttagtatatattgt

SEQ ID NO: 174410 - DNA, 1383 bp, Homo sapiens
  Payload ID: 14231
  Gene Symbol: RERG
  Gene Name: RAS-like, estrogen-regulated, growth inhibitor
  Uniprot ID: Q96A58
  ENST ID: ENST00000546331
  CDS Start-End: 338-880
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctagg

SEQ ID NO: 174411 - DNA, 1490 bp, Homo sapiens
  Payload ID: 14232
  Gene Symbol: RASL10A
  Gene Name: RAS-like, family 10, member A
  Uniprot ID: Q92737
  ENST ID: ENST00000216101
  CDS Start-End: 511-1122
ggttacctcatcgccgcctccgggaggccccgctcgctcgcgccggcggctggggcggcgactccaggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcgacagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 174412 - DNA, 1720 bp, Homo sapiens
  Payload ID: 14232
  Gene Symbol: RASL10A
  Gene Name: RAS-like, family 10, member A
  Uniprot ID: Q92737
  ENST ID: ENST00000401450
  CDS Start-End: 447-794
caggcgcggaagcgagagaaggatagaggcacagaggctccgggaggcagcgctgccccccgcgccccgcaccgctgcgggacccgcgccgcgagaggggcggacttcggcgcctcgcgcgtccgccggcgcctgggttggcgctgcggggcggaggcggtgtctgagcgccgctccggctctgctctctctcgagcttcggcacccgcccgagccgctcgcgcgcccgccacctgtctgcccactcggctgtctgtctgccctcccgccgccagctcctgcctcgggcctgccctctccggtctcggtgctccgaggggcgacgagaagcgcgacggggccgtggcgcaccgggcagggcgcgcggggcgcacggcctgggggcgcacggtgcggcgccggcccatgaggctttccagcgcggggagcgacagcgccggccggccatggggggtagcctgcgggtggccgttctaggcgccccgggcgtgggcaagacggccatcatccgccagttcctgttcggtgactaccccgagcgccaccggcccacggacgggccgcgcctctaccgacccgcggtgctgctcgacggcgccgtctacgacttgagcatccgcgacggcgacgtcgctggccccggctcgagccccgggggtccggaggagtggccagacgctaaggactggagcttgcaggacacggacgccttcgtgctcgtctacgacatctgcagcccggacagtttcgactacgtgaaggccctgcggcagcgcatcgcggagaccaggtaggggcccggcagttctggcggtggggagctaggacaggtctggcagggcctttgcctgaggagagtgtgtagggtctcccaacgtcgtgggccgggtcttaggccttcgcccgtgggaaggtcttaagctgtatgtgctctttggcccacatgggcctggggtttcgttggggcggcggggggggcggtgtctctggccgtaggaagggaatgcgcctgcgtgtgtatacccactgggggaattctccggccgtggggtccccgcgtctctcatctccattcggcccccaggccggcgggcgcgcccgaagcgcccatcctcgtggtaggcaacaagcgggacaggcagcggctgcgcttcggaccgcggcgcgcgctggccgccctagtgcgcaggggctggcgctgcggctacctcgagtgctccgccaagtacaactggcacgtgctgcgtctcttccgcgagctgctgcgctgcgctctggtgcgcgcgcgccctgcacacccggccctgcgcctgcagggggcgctgcatcccgcgcgctgcagcctcatgtgacccgatcggacagtgccatccatgggccccaccttgtgactgggacaatcagggacctggattggacgggatcgcccaacttcactgggactggacagggaagtctccgccctgattggatgaggaaagctccaacccagtctcctaagcgactggcccccttttgaacctcattggacccaaccaggtcccaagctccattggagatgaccagtcctttctgggacctcaatgggtcacaatcccattggatggaaaggacttggctatgaacttgactggaaacacgcagcctgctcctggagcttcactggacatattctttatgccacacctaccacgggataataaaagggaaaataatttga

SEQ ID NO: 174413 - DNA, 3205 bp, Homo sapiens
  Payload ID: 14233
  Gene Symbol: RASL10B
  Gene Name: RAS-like, family 10, member B
  Uniprot ID: Q96S79
  ENST ID: ENST00000603017
  CDS Start-End: 378-989
gagcaggcggcgcgctccggagggagagctggggctggaggttcctaccccctcggcggcccgcatctgcccccgcgcgcccgccctgagcccgccccgactgggcaggcgggggagcccctacttctctccccccgggcgggggagccggggggcagcgccggagcccggggggagctcagccccgccgaccggccggccagggcagggggcagctaggacggccccggtccaggtggaggccgcagagggcccagggcaagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccaggagtgggcagacacctgctgcaggggactccggagtgtccacgcctacatcctggtctacgacatctgctgctttgacagctttgagtacgtcaagaccatccgccagcagatcctggagacgagggtgatcggaacctcagagacgcccatcatcatcgtgggcaacaagcgggacctgcagcgcggacgcgtgatcccgcgctggaacgtgtcgcacctggtacgcaagacctggaagtgcggctacgtggaatgctcggccaagtacaactggcacatcctgctgctcttcagcgagctgctcaagagcgtcggctgcgcccgttgcaagcacgtgcacgctgccctgcgcttccagggcgcgctgcgccgcaaccgctgcgccatcatgtgacgcctgcgcgcccctcgggctgcaccggcactggccgagcggagggcggggccgtactgcggggctggggcggggagcgggcgggaaatggaactgtgacggtcccggcctgaggcccctgcagccacgcacctcccggtgagaagcagagcgcgagagggagccctccgtaactgcccagccctgccccttgcccccgtggcttcctgggacagccgccttcagtgctgtatttagtgcagtgcccggcccgacccgcgggggtgccacagccttttgggatgggggtgagcgtgcaatggaggctgggggtggcgaggtgccgccttggccgggcccccacgtgtcttctccagaatgtgtctgtctttgcctggtgtcttcctttcccgtgtccgcccaccccagcgtctgttggtacttacctgtctcacctaccctccagtcccctcccagctccgctcacagggctctcatttcgtccatccccttgtcgcagatcctggcagcttctttgtgaggccaggccttctgactgtcagcaccaccggcacagggcagagatgcgggtggcccaaggaccacgatcaaggggtccgggggaccgaggtcccagatcagtgaggggagaaggttgagctctccggcttccagggagacctccccgcccagcagcccccagagacacaacaacctaccttccagccttaactcgatggtccgtccctgccaggtgcccctcactcttcctgaccccaaagccagatcaccccctgggttaaaactttttttcttttttttttttggacagagtgtggaaagggagccccccaaaggatagcttctttttcatgatgccaggctccagtcctttattcccttctgcatactgcaatctgatctgtcagactggggaatgttgggttctggggtctggtcgtgggcaggatggtgcccagaagggggttaggttgtcccagtgaaaattctgttgccccgtctcaaccccatctgactaccccagactctgcctgcctcagatctcagactatcctgattaatctggggaagaacagagccagggaaagaatggtggggacccctgtacttgggggagacacacctgcatcttcctcctgccacagatggaggccctcaggatctgacaccctcttgtcccaacaccagtcagccctataccctaactcactccaccccattttctccggctgcctggccgggtttctacctctcgtcaccggagctgatcactgtcagttttgtaccgatttagaaataacaataataatgaagattctaggaatggcatgagggattgatgggggacttggagggagggacaagtggtgccctgtcccctgctcccctggccaaagaaagctgtccttgaggctgagccctcagccctggcctggtggggggacagcaaggtcccttgttataagaggggcagagaggacaactccgctttggccaacctagccaaggctgcagcatatagaccaggaaatcaggtagcccagactggtgatggagcagagtctgggggaagggtcgtgggtggggaatttatcaccaacatccattgtagggggaatctatgattctgcttccccagcggattcccactctgtccaccaagtggggggtagcacagcctcacagcaaccgccctgaccttgggcagtctagtgttcctgcattctagtccctgctgtgctgcaggactttgggcaagtgacctgccctctgtgagcctccctctgacacagaggaggtggctccccttccccacaccttagagtggctgggagggtaacaaagagggcctgcccctttagtctcctgcacccctgccccctggttcaccagagggagcggatgaaggatggcagcatctcacatgccccatcaccaactctgaggcacctggggtgggggggcggagcccaggcctctggctgctcccctgtgggagccattggaatgtatcccctgacaggcccccttccgcctccacctcaacccaggtcttggatttcaggtccctccacccccattctgagtctctgtccttctccttccacccgctcccagggtttcccaccacagggtctggaagtgtgtgtgacgcccattgagctgttacccgaagtcagattaaaaatcagggagtgttttccctcgtttctgta

SEQ ID NO: 174414 - DNA, 1543 bp, Homo sapiens
  Payload ID: 14234
  Gene Symbol: RASL11A
  Gene Name: RAS-like, family 11, member A
  Uniprot ID: Q6T310
  ENST ID: ENST00000241463
  CDS Start-End: 619-1347
gggcctcccaaagtgctgggattacaggcgtaagccaccgcgcccagccccttagcaccttttaaaaataaaaagggcagcgttttacagcaatctgtcccattgttgcagaaacatccaactgattgcactttttcttcttctctcgtcaactcgtaactcctatctcaagttcacccacaggtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtgcagctaaaagactgggcttctcgctttttaatcacacattcagagtttatttttataaaaaaattgattttcaagtacatgtgtatttctgaaaattcaaacagtgattgcctagaagctggataaaattttgttttgttttattaaaagaac

SEQ ID NO: 174415 - DNA, 1995 bp, Homo sapiens
  Payload ID: 14235
  Gene Symbol: RASL11B
  Gene Name: RAS-like, family 11, member B
  Uniprot ID: Q9BPW5
  ENST ID: ENST00000248706
  CDS Start-End: 219-965
aaaacagccggcgcgccgcgcgagtgcagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaaga

SEQ ID NO: 174416 - DNA, 2640 bp, Homo sapiens
  Payload ID: 14236
  Gene Symbol: RASL12
  Gene Name: RAS-like, family 12
  Uniprot ID: Q9NYN1
  ENST ID: ENST00000220062
  CDS Start-End: 278-1078
gctccaggagccggctgagcgcgccccgcggggggctccgcagcccttacaaggaatttggtggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagccgtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacagaa

SEQ ID NO: 174417 - DNA, 1523 bp, Homo sapiens
  Payload ID: 14236
  Gene Symbol: RASL12
  Gene Name: RAS-like, family 12
  Uniprot ID: Q9NYN1
  ENST ID: ENST00000421977
  CDS Start-End: 109-852
ccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctgaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagcccca

SEQ ID NO: 174418 - DNA, 982 bp, Homo sapiens
  Payload ID: 14236
  Gene Symbol: RASL12
  Gene Name: RAS-like, family 12
  Uniprot ID: Q9NYN1
  ENST ID: ENST00000434605
  CDS Start-End: 93-860
tggctcatgtgatgtggtggcccgcaggctgtatggctgcaggcccggagggcatctggagacctgtgtgatcactcatatccttagaagaaatggtaataatgggtccagaattggtgggttcttggtctgacttcaagaatgaagccgcggaccctcgagccctgaccgtgaagtttctgaccaagaggtttatcagtgaatatgaccccaacttggaggacacctacagctccgaggagactgtggaccaccagcctgtccacctgagggtcatggacactgcagacctggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagca

SEQ ID NO: 174419 - DNA, 1569 bp, Homo sapiens
  Payload ID: 14237
  Gene Symbol: RRAD
  Gene Name: Ras-related associated with diabetes
  Uniprot ID: P55042
  ENST ID: ENST00000299759
  CDS Start-End: 252-1178
attcccctggtgggggtggacagacacgtcagcccccgcagcagcgtggaccgggggcgggagcgggggcgggtggaggcttaaataggcggctctggagccagagcccagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 174420 - DNA, 1476 bp, Homo sapiens
  Payload ID: 14237
  Gene Symbol: RRAD
  Gene Name: Ras-related associated with diabetes
  Uniprot ID: P55042
  ENST ID: ENST00000420652
  CDS Start-End: 153-1079
cagtgcgggctgagaaggcggtggctgcagcagcagcggcggcggaaaccctaaagtccgagtccggactacgagtgcgtggcctcctaatccggatcctagtcctgagcgtgtctgtgtgcgagtggatcccctagacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgatagtcatg

SEQ ID NO: 174421 - DNA, 409 bp, Homo sapiens
  Payload ID: 14237
  Gene Symbol: RRAD
  Gene Name: Ras-related associated with diabetes
  ENST ID: ENST00000568915
  CDS Start-End: 1-409
ggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggaggga

SEQ ID NO: 174422 - DNA, 484 bp, Homo sapiens
  Payload ID: 14237
  Gene Symbol: RRAD
  Gene Name: Ras-related associated with diabetes
  ENST ID: ENST00000566577
  CDS Start-End: 1-484
cgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccg

SEQ ID NO: 174423 - DNA, 2323 bp, Homo sapiens
  Payload ID: 14238
  Gene Symbol: RAC1
  Gene Name: ras-related C3 botulinum toxin substrate 1 (rho family, small GTP binding protein Rac1)
  Uniprot ID: P63000
  ENST ID: ENST00000348035
  CDS Start-End: 214-792
tttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaa

SEQ ID NO: 174424 - DNA, 907 bp, Homo sapiens
  Payload ID: 14238
  Gene Symbol: RAC1
  Gene Name: ras-related C3 botulinum toxin substrate 1 (rho family, small GTP binding protein Rac1)
  Uniprot ID: P63000
  ENST ID: ENST00000356142
  CDS Start-End: 198-833
agttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaa

SEQ ID NO: 174425 - DNA, 1482 bp, Homo sapiens
  Payload ID: 14239
  Gene Symbol: RAC2
  Gene Name: ras-related C3 botulinum toxin substrate 2 (rho family, small GTP binding protein Rac2)
  Uniprot ID: P15153
  ENST ID: ENST00000249071
  CDS Start-End: 123-701
cctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggaga

SEQ ID NO: 174426 - DNA, 893 bp, Homo sapiens
  Payload ID: 14239
  Gene Symbol: RAC2
  Gene Name: ras-related C3 botulinum toxin substrate 2 (rho family, small GTP binding protein Rac2)
  ENST ID: ENST00000406508
  CDS Start-End: 257-703
cagcacagagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcagg

SEQ ID NO: 174427 - DNA, 842 bp, Homo sapiens
  Payload ID: 14239
  Gene Symbol: RAC2
  Gene Name: ras-related C3 botulinum toxin substrate 2 (rho family, small GTP binding protein Rac2)
  ENST ID: ENST00000405484
  CDS Start-End: 285-842
caggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaaggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaaccgtgttcgacgaggccatccgggccgtgctgtgccctcagcccacgcggcagcagaagcgcgcctgcagcctcctctag

SEQ ID NO: 174428 - DNA, 569 bp, Homo sapiens
  Payload ID: 14239
  Gene Symbol: RAC2
  Gene Name: ras-related C3 botulinum toxin substrate 2 (rho family, small GTP binding protein Rac2)
  ENST ID: ENST00000401529
  CDS Start-End: 101-361
tcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgcctgggaggccctgcgctctattgcaggatgcggaggcagggctgtcatcggacgtggagggagcgtgttggtgtcagactcaggagggaaggatgactggggaggcaccagcccctccctggccagccctcaggggtccccatcactcctaggacatttccccgactccctagcatggcactcaaggctcctgatggccttcactcaacctcccacctggccttattacccattactttgcttcacactctgcctcctccggaccctactgttcgccacaagctccctgcacatttctaccccagggcctttgctcaagctgttctctctccccatagtgctttttctccccacatccac

SEQ ID NO: 174429 - DNA, 705 bp, Homo sapiens
  Payload ID: 14239
  Gene Symbol: RAC2
  Gene Name: ras-related C3 botulinum toxin substrate 2 (rho family, small GTP binding protein Rac2)
  ENST ID: ENST00000441619
  CDS Start-End: 207-705
gagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgaaaacgcgcctggccctgagctgtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagctctcacccagagaggcctgaaaa

SEQ ID NO: 174430 - DNA, 1090 bp, Homo sapiens
  Payload ID: 14240
  Gene Symbol: RAC3
  Gene Name: ras-related C3 botulinum toxin substrate 3 (rho family, small GTP binding protein Rac3)
  Uniprot ID: P60763
  ENST ID: ENST00000306897
  CDS Start-End: 139-717
gtctccgcgcccggcgctcggcggcgctcggctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacggcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccaccta

SEQ ID NO: 174431 - DNA, 730 bp, Homo sapiens
  Payload ID: 14240
  Gene Symbol: RAC3
  Gene Name: ras-related C3 botulinum toxin substrate 3 (rho family, small GTP binding protein Rac3)
  ENST ID: ENST00000584341
  CDS Start-End: 341-730
ccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgc

SEQ ID NO: 174432 - DNA, 831 bp, Homo sapiens
  Payload ID: 14240
  Gene Symbol: RAC3
  Gene Name: ras-related C3 botulinum toxin substrate 3 (rho family, small GTP binding protein Rac3)
  ENST ID: ENST00000580965
  CDS Start-End: 424-831
cctcccagtgggtggggccaggcctctcacctgggctgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgccc

SEQ ID NO: 174433 - DNA, 1589 bp, Homo sapiens
  Payload ID: 14241
  Gene Symbol: RRAGA
  Gene Name: Ras-related GTP binding A
  Uniprot ID: Q7L523
  ENST ID: ENST00000380527
  CDS Start-End: 266-1207
gggacgcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattc

SEQ ID NO: 174434 - DNA, 1573 bp, Homo sapiens
  Payload ID: 14242
  Gene Symbol: RRAGB
  Gene Name: Ras-related GTP binding B
  Uniprot ID: Q5VZM2
  ENST ID: ENST00000262850
  CDS Start-End: 444-1568
cagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaatactagaccgtatacatagtcttcaaattaatagcagtttgagcacctactctctcgtagactctgttggaaatacaaagacatttgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacatt

SEQ ID NO: 174435 - DNA, 2061 bp, Homo sapiens
  Payload ID: 14242
  Gene Symbol: RRAGB
  Gene Name: Ras-related GTP binding B
  Uniprot ID: Q5VZM2
  ENST ID: ENST00000374941
  CDS Start-End: 590-1630
ggggtaaggcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggga

SEQ ID NO: 174436 - DNA, 644 bp, Homo sapiens
  Payload ID: 14242
  Gene Symbol: RRAGB
  Gene Name: Ras-related GTP binding B
  ENST ID: ENST00000414239
  CDS Start-End: 63-644
agatgcccacgtgatcctggcctgcagttgggtggctgcggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaa

SEQ ID NO: 174437 - DNA, 2732 bp, Homo sapiens
  Payload ID: 14243
  Gene Symbol: RRAGC
  Gene Name: Ras-related GTP binding C
  Uniprot ID: Q9HB90
  ENST ID: ENST00000373001
  CDS Start-End: 178-1377
ggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaatgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctctagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcaggtgattctgacttgagtatttacatggaccatggtgatatccaaaagaaaaatgctttttatatttatagattatttcattgaactatatatgaaatgggtatcaataaatgtatttactccaaaa

SEQ ID NO: 174438 - DNA, 4042 bp, Homo sapiens
  Payload ID: 14244
  Gene Symbol: RRAGD
  Gene Name: Ras-related GTP binding D
  Uniprot ID: Q9NQL2
  ENST ID: ENST00000359203
  CDS Start-End: 235-984
tgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgta

SEQ ID NO: 174439 - DNA, 4900 bp, Homo sapiens
  Payload ID: 14244
  Gene Symbol: RRAGD
  Gene Name: Ras-related GTP binding D
  Uniprot ID: Q9NQL2
  ENST ID: ENST00000369415
  CDS Start-End: 278-1480
ctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtacagactggatgtaatttgtaatcaggtatagtccatgttttactttaagcagtacatcacttaataaccattgttaagccattgctttcaagaatgttaactgccaatttaaaagcatgtgtcctaggttcatgctttggtaaagctctcatttcaagtgtattcatagctaagctttctgggagcagaattgtctctttggtgaaaaggaagtacagcctttcctgtttctgaggttgcttaccatacatgtatgtcactgtttcattggccctgttacatccatttggtaaaatttatttgtcctgattaaccagctctcattttatggaaatgatgataaatctcactacttaaattta

SEQ ID NO: 174440 - DNA, 495 bp, Homo sapiens
  Payload ID: 14245
  Gene Symbol:
  Gene Name: Ras-related protein Rap-1b-like protein  [Source:UniProtKB/Swiss-Prot
  Acc:A6NIZ1]
  ENST ID: ENST00000506621
  CDS Start-End: 1-495
atgcgtgagtataagctagtcgttcttggctcacgaggcgttggaaagtctgctttgactgtacaatttgttcaaggaatttttgtagaaaaatacgatcctacgatagaagattcttatagaacggagcaatttacagcaatgagggatttatacatgaaaaatggacaagggtttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctt

SEQ ID NO: 174441 - DNA, 1917 bp, Homo sapiens
  Payload ID: 14245
  Gene Symbol:
  Gene Name: Ras-related protein Rap-1b-like protein  [Source:UniProtKB/Swiss-Prot
  Acc:A6NIZ1]
  Uniprot ID: A6NIZ1
  ENST ID: ENST00000631802
  CDS Start-End: 149-703
gtaaaccagccggagcggcgcggcagcggcaggaccgccgtggcgcctagagtagcgacccgcggggagcacggggcgacgctggctgcagagacccggtgacagcgtgagaggttcgcagagtactaggttttgacaagcttgcatcatgcgtgagtataagctagtcgttcttggctcacgaggcgttggaaagtctgctttgactgtacaatttgttcaaggaatttttgtagaaaaatacgatcctacgatagaagattcttatagagagcaagttgaagtagatgcacaacagtgtatgcttgaaatcttggatactgcaggaacggagcaatttacagcaatgagggatttatacatgaaaaatggacaagggtttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtatgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacagtgatcttgtctttaaaatatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgt

SEQ ID NO: 174442 - DNA, 6635 bp, Homo sapiens
  Payload ID: 14246
  Gene Symbol: RB1CC1
  Gene Name: RB1-inducible coiled-coil 1
  Uniprot ID: Q8TDY2
  ENST ID: ENST00000025008
  CDS Start-End: 525-5309
gtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaggtgagggtgcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttcaca

SEQ ID NO: 174443 - DNA, 6614 bp, Homo sapiens
  Payload ID: 14246
  Gene Symbol: RB1CC1
  Gene Name: RB1-inducible coiled-coil 1
  Uniprot ID: Q8TDY2
  ENST ID: ENST00000435644
  CDS Start-End: 516-5291
aacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccagcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 174444 - DNA, 891 bp, Homo sapiens
  Payload ID: 14246
  Gene Symbol: RB1CC1
  Gene Name: RB1-inducible coiled-coil 1
  ENST ID: ENST00000518211
  CDS Start-End: 312-440
ggaagagacggagtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctg

SEQ ID NO: 174445 - DNA, 507 bp, Homo sapiens
  Payload ID: 14246
  Gene Symbol: RB1CC1
  Gene Name: RB1-inducible coiled-coil 1
  ENST ID: ENST00000518468
  CDS Start-End: 462-507
agagagggagcttcgccatgtttctcaggctgatctcgaatttctgacctcaagtaatccgcccgcctcggcctcagaagtgctgagattaggggcttgagccaccgcacccgaccttcttttaaatttaaattagatggccagaggtggggcaaatgcataaataccctaaaaaggatttaaggaagagagttctgaggtgtttattctgaacttagaactaacgtttctacagcatttgctttcgtccgcctctacctccaccacggaaggataagaactagactttgacaagttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacat

SEQ ID NO: 174446 - DNA, 711 bp, Homo sapiens
  Payload ID: 14246
  Gene Symbol: RB1CC1
  Gene Name: RB1-inducible coiled-coil 1
  ENST ID: ENST00000518710
  CDS Start-End: 554-711
caataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatc

SEQ ID NO: 174447 - DNA, 551 bp, Homo sapiens
  Payload ID: 14246
  Gene Symbol: RB1CC1
  Gene Name: RB1-inducible coiled-coil 1
  ENST ID: ENST00000517963
  CDS Start-End: 334-551
gtttcccggcatgcgccgcggaggaagagacggagtcgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggtgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaaga

SEQ ID NO: 174448 - DNA, 560 bp, Homo sapiens
  Payload ID: 14246
  Gene Symbol: RB1CC1
  Gene Name: RB1-inducible coiled-coil 1
  ENST ID: ENST00000523594
  CDS Start-End: 1-328
acaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatcccca

SEQ ID NO: 174449 - DNA, 470 bp, Homo sapiens
  Payload ID: 14246
  Gene Symbol: RB1CC1
  Gene Name: RB1-inducible coiled-coil 1
  ENST ID: ENST00000519912
  CDS Start-End: 1-383
ggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccagcttcaggtgcatctagaagaccctgggtacttggaaaagtaatggaaaaagaatactgtcaagccaaaaagtgctcattcatcactccaaaaacagcaggccatctttttatgcaaaagtcagcgtgacaatatacttcactggtgtacatcgtttactttttaactggcttcattttaggaataataaattcatcagaatccttggctgaatta

SEQ ID NO: 174450 - DNA, 766 bp, Homo sapiens
  Payload ID: 14247
  Gene Symbol: RBAK-RBAKDN
  Gene Name: RBAK-RBAKDN readthrough
  ENST ID: ENST00000396904
  CDS Start-End: 93-434
ggctttggcctccagtggacgagaatcgcggagcctgcggggctggaggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 174451 - DNA, 1001 bp, Homo sapiens
  Payload ID: 14247
  Gene Symbol: RBAK-RBAKDN
  Gene Name: RBAK-RBAKDN readthrough
  ENST ID: ENST00000407184
  CDS Start-End: 267-998
acagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcatgtgggccctgcacgagctcaaaggacactatgcaatcacccgaaaggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaagccgccctgcccgcaggccatgtggcccccgctgttgctgctgctgctgctgctcccggccgccccggtccccaccgccaaagccgctccccacccggatgctaacacccaggaaggccttcagaacctgctccaaggagtcggggctggcggagacggagagctgcgggcagactcacacctggccccgggctctggctgtattgatggggctgtggtggccacgcgaccagaaagccggggaggaagacctgcggttccgtgagaggcgtccagggctgcaggccacggcgacaggctccggggaacatggggctttccctgtccactcccaaggagtgtgggcctcaacgcattggcaggggacggccgtgtgccctctccagaccccacccccagatgcatttattagaaataataaagttctttcttagcta

SEQ ID NO: 174452 - DNA, 4125 bp, Homo sapiens
  Payload ID: 14248
  Gene Symbol: RBAK
  Gene Name: RB-associated KRAB zinc finger
  Uniprot ID: Q9NYW8
  ENST ID: ENST00000353796
  CDS Start-End: 325-2469
ctctctgtgtgcgtgttcgcgcatgcgcgccgccgctgcactgccctcgcttcctgtgcgtcctcaggtcaccgcttgctctagttcccaggctttggcctccagtggacgagaatcgcggagcctgcggggctggaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaa

SEQ ID NO: 174453 - DNA, 6551 bp, Homo sapiens
  Payload ID: 14248
  Gene Symbol: RBAK
  Gene Name: RB-associated KRAB zinc finger
  Uniprot ID: Q9NYW8
  ENST ID: ENST00000396912
  CDS Start-End: 520-2664
ccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttggtaagttccctgcataaaagttatgcaaaaagcattttatgatataccagcaaaaaacatggaaaatgaaattttgaaaagcaatgccacttcaaagatccctcaagtgcctagagggagaaaatgagttaatatgctttgaagaactgtatccagaaaataaaattacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattagggtagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaac

SEQ ID NO: 174454 - DNA, 2793 bp, Homo sapiens
  Payload ID: 14249
  Gene Symbol: RBBP8NL
  Gene Name: RBBP8 N-terminal like
  Uniprot ID: Q8NC74
  ENST ID: ENST00000252998
  CDS Start-End: 158-2152
ttctctctccctgtgaagagcgtgggggactccgcgcagaggtcgacagaggttgaggcagggccaggagccatgatggacacagaggggcagtagaggctgcaggcgtctccacaaccccagcgcagaggggcccgggccagggccacagggagccatggagagcttcatggagtcgctgaacaggctgaaggagatccacgagaaggaagtcctgggcctgcagaacaagcttctggaactgaactcagagaggtgccgggacgcccagaggatcgaggagctcttctccaagaaccaccagctccgggaacagcagaagacactgaaggagaacctgcgggtgctggagaacaggctgcgggccggcctgtgcgaccgctgcatggtcacccaggagctggccaggaagcggcagcaggagttcgagagctcccacctgcagaacctgcagcgcatcttcatcctcaccaacgagatgaacgggctgaaggaagagaacgagaccttgaaggaggaggtgaagcggcttcggggcctgggagacaggcccaagccccgggccaaggagggcacctcggaccccccctcacccctgctgctcccctcccctggtggctggaaggccatcacagagaagccaccgggaggccacgaggaggctgaggaagaccaccagggcgtgggcctacggggagaagaaaagccagcagggcacaggacatctccagtggccaaaatctccccaggggccaccctgcctgagtcgcgagccccagacatgagcccccagcgcatctccaaccagctgcacgggaccattgccgtggtgcggcctgggtcccaggcttgccctgccgaccgaggccccgccaatgggacgcccccaccactgcccgccaggagcagcccacccagcccagcgtatgagcgtggcctctccctggacagcttcctgcgggcctcccggccctccgccatgacccatgaggccccgaagctctccccgaaggtggaccggctctgcctcctaaaccgccccctgtccctgcaccttcagagcccccacagcagccccctggcccctgctgcagcccccagcgacccccggctccaggacctgaaggccagagaagcagaggcctgggaggagcccacagaactgctggggctgcccagtgccctggcgggcatgcaggaccttcgcctggagggggcactgcacctgctcctggcccagcagcagctgcgggctagggccagggcaggcagtgtcaggccaaggggccagcccacacccggggagatgctgccctccctaccagtcggctcagactctgagggccctgagaatgaggggaccagggcagctctggccgcagcaggcctgtctggagggcggcacacacagcctgcaggcccgggccgcgcccagaggacagaggctgcagccacgcaggactgtgccctagacaagcccctggacctctcggagtggggccgggcccggggccaggacactcccaagccggccggccagcatgggtcactcagccctgccgctgcccacactgccagccccgagccacccacccagtccggacccctgactcgcagtccccaggcactcagcaatggcaccaaggggaccagagtgccagagcaggaggaggcttccactcccatggacccctcacgcccacttccagggtcccagctcagcctgtcctctccaggcagtacagaagatgaagacacagggaggcctctgccacctccccacccacagccgcctccccacccacagccgcctgacctggacggccacccagagcccagcaaggctgaagtgctgagaccagagtccgacgaactggatgagacagacaccccaggcagcgaggtgggcctgagctcccaggcggaggccactacgagcacgaccggggaggggcctgagtgcatctgcacccaggagcacgggcagggtccaccacggaagaggaagcgggcctcggagcctggggacaaagcctccaaaaagccatccagagggagaaggaaactgacagccactgaggggcccgggagcccaagggacgccgaggaccacagtccctcccccaacagcagcccctgggaggagacctagccagcctgcaccagggtccacagcgagcccggggcagccctccacctgcccaccagggcctggagagggcacaccatccaaccagcaggcagccctgcacagaaccctgggagaagacctagccagcctcagctgaacccacagtgagcccagggcagctctctgcctgctcaccacagcctggagagggcacaccacccaaccagcaggcaaccccgaagagccggtgacgggcacatcctggcccacttcaagaggggctggaggaccgagaggggtctcaggctggcgattcaccccgtctccacccacctgggaaatgctctgcggcccctcccacagcccagcacctgctccctgaggggtgtggggactggaggcgggatcactcaggctccagcccagccctacccctgctgtgcactgcagccgttcccaggcagtgcccacgctctgggaggcaacggaccactcggacccccacccctgcccgccaagctccaagcacaatcttggacgccccctcgtgggctgacagcaaacagatgtctggcagtgagggtggagggagacagtgggcggcagcaccctcgaagaccgggtcccctgagtgacggagaataaacacttgaagaaccgtg

SEQ ID NO: 174455 - DNA, 1566 bp, Homo sapiens
  Payload ID: 14250
  Gene Symbol: RBM14-RBM4
  Gene Name: RBM14-RBM4 readthrough
  ENST ID: ENST00000412278
  CDS Start-End: 96-1115
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 174456 - DNA, 2034 bp, Homo sapiens
  Payload ID: 14250
  Gene Symbol: RBM14-RBM4
  Gene Name: RBM14-RBM4 readthrough
  ENST ID: ENST00000421355
  CDS Start-End: 91-534
ttcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctca

SEQ ID NO: 174457 - DNA, 829 bp, Homo sapiens
  Payload ID: 14250
  Gene Symbol: RBM14-RBM4
  Gene Name: RBM14-RBM4 readthrough
  ENST ID: ENST00000500635
  CDS Start-End: 52-408
gtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 174458 - DNA, 2041 bp, Homo sapiens
  Payload ID: 14251
  Gene Symbol: RITA1
  Gene Name: RBPJ interacting and tubulin associated 1
  Uniprot ID: Q96K30
  ENST ID: ENST00000549621
  CDS Start-End: 685-1494
gcggtgaccacgtgacctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcaggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatcaaa

SEQ ID NO: 174459 - DNA, 1898 bp, Homo sapiens
  Payload ID: 14251
  Gene Symbol: RITA1
  Gene Name: RBPJ interacting and tubulin associated 1
  Uniprot ID: Q96K30
  ENST ID: ENST00000552495
  CDS Start-End: 473-1354
ctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatc

SEQ ID NO: 174460 - DNA, 2053 bp, Homo sapiens
  Payload ID: 14251
  Gene Symbol: RITA1
  Gene Name: RBPJ interacting and tubulin associated 1
  Uniprot ID: Q96K30
  ENST ID: ENST00000548278
  CDS Start-End: 693-1502
gcggtgaccacgtgacctccgctgagctttcgccagtgcctgcggccctcggcggcctagtacacacgcacctgagtgagtggcaccagaggaccctctccatgtttagggacctcctgggcctcaggagcgtggcgcccgcccctgggcggactccccccatccgcgggcgcgaatggtccgggccgcgtccgcagtgctgctggctgctccctggttgctgggtgcaaagtgctgggttctgggtttctggattcgcgggccgttcacacgtagcctgtgccggctcctcgggtgagtccgtccgcgcgcggtgccccgggacggcctaggctgccgggggtccggggccccaggcattccgggctgcagattgacggggatcccggatgcaccgcgcgcccccgcgccctcaccgacgggtccagacctggtgggaagaaggtgcggggacgggtccctgaggatcccgatgcctacgagccaagatgctcagctttataggtgtgacctacacatgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagcatgaagacccccgtggagctggccgtcagtgggatgcagaccctcggccttcagcaccgctgccgaggtggctaccgggtcaaggccaggacgtcatatgtggatgagactctgtttggcagcccagcaggcacccggcctaccccaccggacttcgatccgccctgggtggagaaggctaacagaaccagaggcgtgggcaaggaggcatcgaaggccttgggggcaaaggggagctgtgagaccaccccctcaaggggcagcacccccaccctcacaccaaggaagaagaacaaatacagacccatcagccacaccccgtcttactgtgatgagtcgctgtttggctcccgatctgaaggcgccagcttcggggccccgcggatggcgaagggggatgccgcaaagctccgtgctctcttgtggacgccaccacctacccccaggggtagccactcgccccgccccagggaggcaccactgcgagccattcacccagctggtccctccaagacagagccggggccagcggcagactcccagaagttatctatgggtgggttacactcttcacgccccctgaagcggggactttcccattccctcacccacctgaatgtccccagcactggtcatccagccaccagtgccccccacacaaatgggcctcaggatctcaggccttccacgtcaggggtgaccttccggagccccctggtgacttccagggctcgctcagttagcatttcagtgccatctaccccacgacgaggtggggccacccagaaaccaaagcccccttggaaatgatactctttcatcagggttgcctatggggccacggcgacaggtatggccccttgccagggtaggaggacattcatcacccagggaaccccaggtattaaagaagcccctgtgggggcagacagacatagcaggggtgggcagtgcctccctttatcctgacaatctctagtcgattcttgcctttttctcccgattgcggatttgggggccacctctaagatgcctctctccagccctgtctcaaccatactccaaattagtgccaacccaggggcctggcacctcccacatcatccattgtcttgctgccaagtgcgaataaacggcgtgattgccaacctggagggtcccctcttatcccttcaagccaagcttcctgctcaggattagtttccagctaagtctgcaagccctagaggagtttttccaggctgtctgtgaagcctggggaacacaacggcaactgggagatttgtgagtgaacactgtttcatcttaatatgcttctgaatttattttcatgtactaaatagatcagctcatcaaagcca

SEQ ID NO: 174461 - DNA, 369 bp, Homo sapiens
  Payload ID: 14251
  Gene Symbol: RITA1
  Gene Name: RBPJ interacting and tubulin associated 1
  ENST ID: ENST00000615042
  CDS Start-End: 1-117
agaggcgtgggcaaggaggcatcgaaggccttgggggcaaaggggagctgtgagaccaccccctcaaggggcagcacccccaccctcacaccaaggaagaagaacaaatacaggtaatggggtagggagatgcaaatcctgtactcagtgcagccacctggattccagttacagctctggtgttcacctgctctgtgaccttgggcaagcatcttgacctctctgagccagtttactcatgtggaaaataggaccaattattcctacctagggggattgttgatggattaaatgagagaggggtctgcagtgcttcgcacagtaacctaatacttagaaagctgtcaataaatggtagtgttgatggtt

SEQ ID NO: 174462 - DNA, 382 bp, Homo sapiens
  Payload ID: 14252
  Gene Symbol: RCAN3
  Gene Name: RCAN family member 3
  Uniprot ID: Q9UKA8
  ENST ID: ENST00000374393
  CDS Start-End: 1-348
atgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgagg

SEQ ID NO: 174463 - DNA, 6802 bp, Homo sapiens
  Payload ID: 14252
  Gene Symbol: RCAN3
  Gene Name: RCAN family member 3
  Uniprot ID: Q9UKA8
  ENST ID: ENST00000374395
  CDS Start-End: 314-1039
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcaggtgaggccccacggcgcccggcctctccagcagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactcagcattgtgcccattttttactgcaagatggaccctgtatgccaggagacatgtattatcaacaattgggaattttttgaatttccttttaggtaatattgattcactgtaattttctaagtgatcaaaacccatgagattttgttatttggcttggctttcattctctgcctgcccattaaagaatattctattcctaacacataaaacattttacagtcaagcagtgcaaattacagtgcttttctattttttttttgagagccttgaataaattgaagaaaactttaaaccaaaattagagacgagtcatttaagcttttctgaatggaaagtattaatattttcatttttctagtataatataataaaatgaatttttttaaaaaagctactaagtacccatcaactttttcatattgtgaaatgaaccaggatcttaacagatactatcatcgctgtccttttttggctgtttaatatctagttcatgtaacaaatttacaagagataagtctcatggttttttttttcttttaataggcttttctgcaatttttttgaaattgagttattacttggatttaaccctgataggaccaggtgtggtggctcacaccataatcccagcactttgggaggccaaggtgggtggatccacctgaggtcaggagttcaagaccagcctgaccaacatggtgaaatcctgtctctacttaaaaaatacaaaattagcctggcatggtggcacatgcctgtaatcccagctacttgggaggctgaggcaggagaatttcctgaaccgggagacggaggttgcggtgagccgagatcacgccatcgcactccagcctcggcaacaagagcgaaactccgtctcaaaaaaaaaagatttaaccctgattgatagtatagtagccatgttttctttagaaatcataacctcttcatgggaatcaaactatgttgaaaattgtgaggaaagataatggtgctttgtgttgggaaaaaaacatttgtgaaggattagaaaaccgtaacacttaacaaggatagtcacagaaccgacgctgcattggctcttaggttctagatttttgtagcacactcacctgatgaaaccaaagacaaatccatgtaaaaagtgttccagtgagcatctctgaggtttaaggtactaagaggcagaagtggatagcaacagttccattgccttcgagaactaaaactcagctggaaagcaaattagtcttttcacattctgcttcttcaaaatgttgtactcaaaaacataccagtaattaagagccaaagcaaagcttcaaggaacttttaagttcaacataaaggtttaaataaaatattttttattttttatttttatttatttatttatttattttgagacagagtctcactctgtcgcccaggctggagcgcagccgcgtgatctcggctcactgcaagctccgcctcccgggttcacgccattctcctgcctcagcctcccaagtagctgggactacaggcgcccgctcccacgcccggctaattttttttttttttttttttataagtagagacggggtttcaccacgttagccaggatggtctcgatctcctgacctagtgatccgcctgccttggcctcccaaagtgctgggattaaccaggcgtgagccactgcgcccggccttaaataaaatattgtagtcattaatggtgtgtttgaattgaagagataccaggagatagaggtgaagtgcagtacttttattctttaagaatatagtctttagccaggtgcagtggtgtgtgcctgtagtctcagctatttgagaggctgaggtgagaggatcacttgagttcaggagttcaagaccagcctgggcaacatagcaagtccctggctcaaaaaaaaaaaagtttcccattcatattaactccatcttttaaaaatgtcatgattacaaagtgaaaagatttggctttcttagaggctcaatcacagaggtgaaagtgaccttggaaatcatatactctatccccatgttacacagattagaaaaactgaggttatggcactgacttaggcacccccagcaaggcaacccagggactacaactggcaatcccaactcctgggctagggctttttctacctttttttgcattggcctcttaaagaggcaatgaatactaattcctggcatcagaaaaaaaaaaaggcatgaggtgggaggattcttttttccctgatgggaaacagtgaataagaaaaatctcatcattcgatggaagaggtgacttaataattttattaatgaatttgatgtcccatgttttgtagttttgttatcattgaaccattggggctggaatctgcctaaataattttatcttggtagccagcaattatgttggtattttatgtgggccttcccagattttcatattaatgaaatgactaatagtcgtacttaagaggtaactctactaaagcagaatgagatctaatatgttgtggaaataaaagagtttgcagtggaatgatactctcactccgtgcttgtaaaattgagttctattcaagacggaactgctatgactggcctattcaaggcttcatatttttatacagactatttcacagaccatagatttattttaaaagggaaaatctcacacataattaagcagtggaaaatgtgctcaatgctatggtgcgtcaggccctctgtctaccaggtttctcccctttctgcagagctgtggaccctgtacgtaccaaacaggtgaacttggtccatctttccttcttcctttttttgcacatttgcatttatatcttcctgtactaaaagaaacaaattatttataattggggtgacaatataaaggaacaaaagatggggcaatagttgcttcctagctggagctgtaagtccatgttacagaaactcactatttaaaaagttttaaaagatttatgaaccttgtcctacaattcgctgaatacttatttgtcttttaaactcccctcggtgtatggatcatcttcgtcagaatgccgttgtttcattgtgaatcaggggaaaatgttaatcatttggagactgttttcttattaccaaatgtacaatccataagacaactgaaagcaacaactgctgggttcactgacaaagattataaaaatcatcacgttcaaagtagagtttttagccaaggtcaagaactaacctggggctgagtcagcgtctctacccacttaaataacagcgtaaagatctttcactaaattcgttatgtggtctgtctggatgtaaacctatatatttccttttgaaacagaatcatatcctgcagactcttggcactcctgcatagctttgaccgaatgttcactctcatcgtaatggaagatttctatctatgcagataatacatgtttttaaatactgttttctgtttagtcctcaatcttcctaactcaaattggggactgaggagagagaaaggtggttacccctgttaccgtgccatattcttcttgctgcttttcaaccccacgtgattgttgattgacggttctgctataatgtgcgtgcccttcaagtttcagaaaactttcccaatcatttcacttcaatcttaattgaacccaagagtcaaagttattattttctccgaacgtgtttgtgatcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaatttttttttggaagcttcgtgattacctgtaacaagttctgtttttaaaacgaatacaaataaagttagtaactatttttaaatca

SEQ ID NO: 174464 - DNA, 667 bp, Homo sapiens
  Payload ID: 14252
  Gene Symbol: RCAN3
  Gene Name: RCAN family member 3
  Uniprot ID: Q9UKA8
  ENST ID: ENST00000412742
  CDS Start-End: 54-575
cctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgc

SEQ ID NO: 174465 - DNA, 997 bp, Homo sapiens
  Payload ID: 14252
  Gene Symbol: RCAN3
  Gene Name: RCAN family member 3
  Uniprot ID: Q9UKA8
  ENST ID: ENST00000425530
  CDS Start-End: 222-917
gtataacagaaaaatgaaccaagcactgtaagagctaagtccacctgacaactttgtcttgaagaaaagattaatgaaagccacagtgagatacactgtcactccctgccccgcttccgcagggcccctttccagattggagatttctggcacgataaatgatgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctg

SEQ ID NO: 174466 - DNA, 2574 bp, Homo sapiens
  Payload ID: 14252
  Gene Symbol: RCAN3
  Gene Name: RCAN family member 3
  Uniprot ID: Q9UKA8
  ENST ID: ENST00000436717
  CDS Start-End: 281-832
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactc

SEQ ID NO: 174467 - DNA, 497 bp, Homo sapiens
  Payload ID: 14252
  Gene Symbol: RCAN3
  Gene Name: RCAN family member 3
  ENST ID: ENST00000482807
  CDS Start-End: 1-326
cctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggaaaagaaaccagaaatacagaataattcatagaaatcatggttctcaagtatttgttcaattagctttggggaagaaa

SEQ ID NO: 174468 - DNA, 2640 bp, Homo sapiens
  Payload ID: 14252
  Gene Symbol: RCAN3
  Gene Name: RCAN family member 3
  Uniprot ID: Q9UKA8
  ENST ID: ENST00000538532
  CDS Start-End: 173-898
gtgctagctccagctcagctacctgcggccgcctctcctcgggcaatgaggcgccgggaagcccacagcatctgataatatccgggccgccggttgccgggaggtgaaccgagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactc

SEQ ID NO: 174469 - DNA, 2527 bp, Homo sapiens
  Payload ID: 14252
  Gene Symbol: RCAN3
  Gene Name: RCAN family member 3
  Uniprot ID: Q9UKA8
  ENST ID: ENST00000616511
  CDS Start-End: 435-785
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcaggtgaggccccacggcgcccggcctctccagcaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactc

SEQ ID NO: 174470 - DNA, 2662 bp, Homo sapiens
  Payload ID: 14252
  Gene Symbol: RCAN3
  Gene Name: RCAN family member 3
  Uniprot ID: Q9UKA8
  ENST ID: ENST00000610732
  CDS Start-End: 195-920
gtaagagctaagtccacctgacaactttgtcttgaagaaaagattaatgaaagccacagtgagatacactgtcactccctgccccgcttccgcagggcccctttccagattggagatttctggcacgataaatgatgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactc

SEQ ID NO: 174471 - DNA, 2386 bp, Homo sapiens
  Payload ID: 14252
  Gene Symbol: RCAN3
  Gene Name: RCAN family member 3
  Uniprot ID: Q9UKA8
  ENST ID: ENST00000618490
  CDS Start-End: 294-644
gtgctagctccagctcagctacctgcggccgcctctcctcgggcaatgaggcgccgggaagcccacagcatctgataatatccgggccgccggttgccgggaggtgaaccgaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactc

SEQ ID NO: 174472 - DNA, 658 bp, Homo sapiens
  Payload ID: 14252
  Gene Symbol: RCAN3
  Gene Name: RCAN family member 3
  Uniprot ID: Q9UKA8
  ENST ID: ENST00000630217
  CDS Start-End: 27-578
aaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctg

SEQ ID NO: 174473 - DNA, 2689 bp, Homo sapiens
  Payload ID: 14253
  Gene Symbol: RCCD1
  Gene Name: RCC1 domain containing 1
  Uniprot ID: A6NED2
  ENST ID: ENST00000394258
  CDS Start-End: 203-1333
ggaaggtaaaagctgcttcctgttggggcatgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaa

SEQ ID NO: 174474 - DNA, 1871 bp, Homo sapiens
  Payload ID: 14253
  Gene Symbol: RCCD1
  Gene Name: RCC1 domain containing 1
  ENST ID: ENST00000555155
  CDS Start-End: 192-1316
gctgcttcctgttggggcatgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaat

SEQ ID NO: 174475 - DNA, 735 bp, Homo sapiens
  Payload ID: 14253
  Gene Symbol: RCCD1
  Gene Name: RCC1 domain containing 1
  ENST ID: ENST00000556333
  CDS Start-End: 1-235
ggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctga

SEQ ID NO: 174476 - DNA, 1556 bp, Homo sapiens
  Payload ID: 14253
  Gene Symbol: RCCD1
  Gene Name: RCC1 domain containing 1
  Uniprot ID: A6NED2
  ENST ID: ENST00000556618
  CDS Start-End: 123-1253
ttagctccttgggagcagacagctgtcctcactggcagaggaggagcgctcagtaaatgctcgctggacgaataaatggctagataagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgt

SEQ ID NO: 174477 - DNA, 4079 bp, Homo sapiens
  Payload ID: 14254
  Gene Symbol: RQCD1
  Gene Name: RCD1 required for cell differentiation1 homolog (S. pombe)
  Uniprot ID: Q92600
  ENST ID: ENST00000273064
  CDS Start-End: 376-1275
agttgtcttgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataatttttcctttacactggagattttattctatcagtatatgggtaactaggcactttggtcaggtgatccttgtcatgcctgcttctcccctctgtctacctacacaacacacacacacacacacacacagccctgctaagatggcagtagtggttcttttgtgaacatgttttttggggagactccatctgaggtacaaaagctgtttgggaggctgggagggggatgatgccccttacctgataaaagtatgttttactgggacagaacttcactcctggccatattggccagaacttagtgccagtgtagggagagacttccatagtgacaaggtaatgcttgaaacatcttacgaactttgatgttcatttcctcaagttcaaggcttggagcacatctccaggattgtttccatgcctggctgtcagtgggacacagctgccctatgcttccacgttcttttttcaagagccttagagggcctgtggcctgtttcactggtggaacaggagcagcattggtagccttcagagcatgccttgcttactaactacatattattcctctgctcattgttcctgctgcttaaaggctaggaaaagggggatatacaaagttgttgctttcaaaaactcagagaaaaaa

SEQ ID NO: 174478 - DNA, 1126 bp, Homo sapiens
  Payload ID: 14254
  Gene Symbol: RQCD1
  Gene Name: RCD1 required for cell differentiation1 homolog (S. pombe)
  Uniprot ID: Q92600
  ENST ID: ENST00000295701
  CDS Start-End: 81-857
ttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggttttcagatttgactttctgctggtcatcttttcaaagaaaatgaaacgtttaaaagttcatctgataatactgctaccatagttttgttttcactgctcatctcttattaaggtttttaaccataaaactgaagcaatttctgtaaagacacaaattgataacttagtatagaattaaaattcattaagttatcataagtttgatgatatccttgttaatgtactgatttttgaattattttatttgccataatccatatatttctaacatgagtattttgacagtatttaataaatcagaaagctgtttgaa

SEQ ID NO: 174479 - DNA, 581 bp, Homo sapiens
  Payload ID: 14254
  Gene Symbol: RQCD1
  Gene Name: RCD1 required for cell differentiation1 homolog (S. pombe)
  ENST ID: ENST00000432877
  CDS Start-End: 97-324
ctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggtgattgtgatgcaagtgatctaagaactacgctttgacgaacaccgctttaggagtactgtaagataaatctacatgacagggggaggaaggtggaaagtagagtataaggaccacaaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctt

SEQ ID NO: 174480 - DNA, 907 bp, Homo sapiens
  Payload ID: 14254
  Gene Symbol: RQCD1
  Gene Name: RCD1 required for cell differentiation1 homolog (S. pombe)
  ENST ID: ENST00000418808
  CDS Start-End: 1-186
atcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctct

SEQ ID NO: 174481 - DNA, 567 bp, Homo sapiens
  Payload ID: 14254
  Gene Symbol: RQCD1
  Gene Name: RCD1 required for cell differentiation1 homolog (S. pombe)
  ENST ID: ENST00000433439
  CDS Start-End: 141-266
agagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcggatctcgctttgttacccaggctggagtgcagtggtgtgatcttggctcaccgcaacctcgaccttctgggttcagtcgattctcccacctcagcctcttgagtagctgggattacaggcaaacgacaccacaccaggctaatttttgtatttttagtaggggcagggtttcactgtgttgaaactcctgacctcaagtgatccaccagcctcagcctcccaaagtgctgggattacagcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactat

SEQ ID NO: 174482 - DNA, 3259 bp, Homo sapiens
  Payload ID: 14254
  Gene Symbol: RQCD1
  Gene Name: RCD1 required for cell differentiation1 homolog (S. pombe)
  Uniprot ID: Q92600
  ENST ID: ENST00000542068
  CDS Start-End: 248-1147
gtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatgtgtattatataaagagacccctccccttattttgtgttttccatccctctcccttaacaggattgaaataaaacatgcttctgtttttgt

SEQ ID NO: 174483 - DNA, 1621 bp, Homo sapiens
  Payload ID: 14254
  Gene Symbol: RQCD1
  Gene Name: RCD1 required for cell differentiation1 homolog (S. pombe)
  Uniprot ID: Q92600
  ENST ID: ENST00000627282
  CDS Start-End: 376-1371
agttgtcttgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattgtagagacggggtttcaccatgttggccaggctgatcttgaactcccgacctcaagtgatctgcccgcctcggcctcccaaagtgctgggattacaggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagcccca

SEQ ID NO: 174484 - DNA, 822 bp, Homo sapiens
  Payload ID: 14255
  Gene Symbol: RCSD1
  Gene Name: RCSD domain containing 1
  ENST ID: ENST00000361496
  CDS Start-End: 232-822
tccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgag

SEQ ID NO: 174485 - DNA, 3135 bp, Homo sapiens
  Payload ID: 14255
  Gene Symbol: RCSD1
  Gene Name: RCSD domain containing 1
  Uniprot ID: Q6JBY9
  ENST ID: ENST00000367854
  CDS Start-End: 332-1582
ttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaatttggga

SEQ ID NO: 174486 - DNA, 3044 bp, Homo sapiens
  Payload ID: 14255
  Gene Symbol: RCSD1
  Gene Name: RCSD domain containing 1
  ENST ID: ENST00000537350
  CDS Start-End: 332-1492
ttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaatttggg

SEQ ID NO: 174487 - DNA, 7300 bp, Homo sapiens
  Payload ID: 14256
  Gene Symbol: REST
  Gene Name: RE1-silencing transcription factor
  Uniprot ID: Q13127
  ENST ID: ENST00000309042
  CDS Start-End: 315-3608
gcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagatttttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaacca

SEQ ID NO: 174488 - DNA, 1103 bp, Homo sapiens
  Payload ID: 14256
  Gene Symbol: REST
  Gene Name: RE1-silencing transcription factor
  ENST ID: ENST00000611211
  CDS Start-End: 34-1056
agaagcccggacgccggctgcgcgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcagtggggtatggataccatttggtaatatttactagagtgtgatctagatgggtgagaagccatttaaatgtgatcagtgcagttatgtg

SEQ ID NO: 174489 - DNA, 1106 bp, Homo sapiens
  Payload ID: 14256
  Gene Symbol: REST
  Gene Name: RE1-silencing transcription factor
  ENST ID: ENST00000622863
  CDS Start-End: 130-1074
ccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtt

SEQ ID NO: 174490 - DNA, 1370 bp, Homo sapiens
  Payload ID: 14256
  Gene Symbol: REST
  Gene Name: RE1-silencing transcription factor
  ENST ID: ENST00000616975
  CDS Start-End: 348-1370
ggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcagtggggtatggataccatttggtaatatttactagagtgtga

SEQ ID NO: 174491 - DNA, 1376 bp, Homo sapiens
  Payload ID: 14256
  Gene Symbol: REST
  Gene Name: RE1-silencing transcription factor
  ENST ID: ENST00000612429
  CDS Start-End: 348-1376
ggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcagagatggagtttcgctcttgttgcccaggctggaataaaatggtgtga

SEQ ID NO: 174492 - DNA, 7114 bp, Homo sapiens
  Payload ID: 14256
  Gene Symbol: REST
  Gene Name: RE1-silencing transcription factor
  Uniprot ID: Q13127
  ENST ID: ENST00000619101
  CDS Start-End: 137-3430
cggcgctcggagcccgacgcctcgcgagggcgcccgcggagcctccccggccctgggcgttgggcgagccccggggcggtcggaggggcccgggggcggtcggagaagcccggacgccggctgcgcgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagatttttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagtttt

SEQ ID NO: 174493 - DNA, 496 bp, Homo sapiens
  Payload ID: 14257
  Gene Symbol: ROMO1
  Gene Name: reactive oxygen species modulator 1
  Uniprot ID: P60602
  ENST ID: ENST00000336695
  CDS Start-End: 183-422
ggtgaggtaggcgccgggcgacgcggggccggaacgcgaagagggtggtggagtcgggctacccactgattttccttcccttacttcccctgagcccttgggcccacttcccagcctaccgcttccgtccccgcccgactcttgggccagcgcctgggcccacactttcctatcccccgcagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagta

SEQ ID NO: 174494 - DNA, 350 bp, Homo sapiens
  Payload ID: 14257
  Gene Symbol: ROMO1
  Gene Name: reactive oxygen species modulator 1
  Uniprot ID: P60602
  ENST ID: ENST00000374072
  CDS Start-End: 16-195
cgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcagctccatcttggtttcctcctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgag

SEQ ID NO: 174495 - DNA, 422 bp, Homo sapiens
  Payload ID: 14257
  Gene Symbol: ROMO1
  Gene Name: reactive oxygen species modulator 1
  Uniprot ID: P60602
  ENST ID: ENST00000374077
  CDS Start-End: 105-344
gctgcccggcgctccggaagcgattcatcgggccgcgagcgccctccccgtcgttttccgtgagagacgtagagctgagcgacccagcccgcgagcgaggtgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtca

SEQ ID NO: 174496 - DNA, 498 bp, Homo sapiens
  Payload ID: 14257
  Gene Symbol: ROMO1
  Gene Name: reactive oxygen species modulator 1
  Uniprot ID: P60602
  ENST ID: ENST00000374078
  CDS Start-End: 181-420
gcggctcggagcagcatggtcccgctggcagagcccaccttccgaagccgctgcagtcctgggccccaggctcccggaagtgctgcccggcgctccggaagcgattcatcgggccgcgagcgccctccccgtcgttttccgtgagagacgtagagctgagcgacccagcccgcgagcgagatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtca

SEQ ID NO: 174497 - DNA, 288 bp, Homo sapiens
  Payload ID: 14257
  Gene Symbol: ROMO1
  Gene Name: reactive oxygen species modulator 1
  Uniprot ID: P60602
  ENST ID: ENST00000397416
  CDS Start-End: 45-284
ggtgaggtaggcgccgggcgacgcggggccggaacgcgaagaggatgccggtggccgtgggtccctacggacagtcccagccaagctgcttcgaccgtgtcaaaatgggcttcgtgatgggttgcgccgtgggcatggcggccggggcgctcttcggcaccttttcctgtctcaggatcggaatgcggggtcgagagctgatgggcggcattgggaaaaccatgatgcagagtggcggcacctttggcacattcatggccattgggatgggcatccgatgctaaccat

SEQ ID NO: 174498 - DNA, 6246 bp, Homo sapiens
  Payload ID: 14258
  Gene Symbol: RLF
  Gene Name: rearranged L-myc fusion
  Uniprot ID: Q13129
  ENST ID: ENST00000372771
  CDS Start-End: 28-5772
gcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccca

SEQ ID NO: 174499 - DNA, 927 bp, Homo sapiens
  Payload ID: 14259
  Gene Symbol: REC114
  Gene Name: REC114 meiotic recombination protein
  Uniprot ID: Q7Z4M0
  ENST ID: ENST00000331090
  CDS Start-End: 29-829
gccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtttttgattccaatgaagaatctggatatcttgttctcaccatagttatatcaggtcatttcttcattttccaaggacagacactactggaagggttttcactcattggtagcaaggactggttgaagattgtaagacgcgtggattgtctgttgtttggaacaacgataaaggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggatcccaccagcactcagaacaacagcaagtgtgtgtaacagcgggcacaggcgctccagacggaaggacctcactgacgcagttagctcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatccaaac

SEQ ID NO: 174500 - DNA, 833 bp, Homo sapiens
  Payload ID: 14259
  Gene Symbol: REC114
  Gene Name: REC114 meiotic recombination protein
  ENST ID: ENST00000560581
  CDS Start-End: 23-739
agtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgccccacatggaaggtttttgattccaatgaagaatctggatatcttgttctcaccatagttatatcaggtcatttcttcattttccaaggacagacactactggacaagagtcgcctgtttcgagtacagttcagtggagagtcaaaggagcaggcgctggaacactgctgcagttgtgttcagaagctggcacaatacataaccgtgcaggtgcctgatggaaacatccaggagcttcagctgattcctggcccacccagggcaactgaaagtcaagggaaggattctgcaaagagtgtcccacggcagcctggatcccaccagcactcagaacaacagcaagtgtgtgtaacagcgggcacaggcgctccagacggaaggacctcactgacgcagttagctcagactcttctggcatcggaggagctgccccatgtctatgaacaatctgcatggggtgcagaagagttaggccccttcctacgtttgtgccttatggatcagaatttcccagcatttgtggaagaggtagaaaaggaactgaaaaagctggcgggtttgagaaattaatgctctatatacatatataactaaggaacttcaaagtattgaaaaatgcttcctcctaaaattaaagaagatattagaataaagagtattatcc

SEQ ID NO: 174501 - DNA, 1007 bp, Homo sapiens
  Payload ID: 14260
  Gene Symbol: REC8
  Gene Name: REC8 meiotic recombination protein
  ENST ID: ENST00000559797
  CDS Start-End: 1-1007
ccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctgggtgagtgtatgcatgtgtgtgtgtgtatgtggggcagggacacagagaccagaggcccgtacagggactcccccgacctgccctctcctcgcctcttgaccagtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattaca

SEQ ID NO: 174502 - DNA, 653 bp, Homo sapiens
  Payload ID: 14260
  Gene Symbol: REC8
  Gene Name: REC8 meiotic recombination protein
  ENST ID: ENST00000560501
  CDS Start-End: 374-653
aagggcggggcccgttggcgcgcgatggcggacgctgcccgggatcccagcctgacagctccccctccatccccattctcccaccttccccacccacttcaggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatac

SEQ ID NO: 174503 - DNA, 635 bp, Homo sapiens
  Payload ID: 14260
  Gene Symbol: REC8
  Gene Name: REC8 meiotic recombination protein
  ENST ID: ENST00000557806
  CDS Start-End: 413-635
aaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctgaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcaga

SEQ ID NO: 174504 - DNA, 2331 bp, Homo sapiens
  Payload ID: 14260
  Gene Symbol: REC8
  Gene Name: REC8 meiotic recombination protein
  Uniprot ID: O95072
  ENST ID: ENST00000611366
  CDS Start-End: 529-2172
atctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattaca

SEQ ID NO: 174505 - DNA, 2405 bp, Homo sapiens
  Payload ID: 14260
  Gene Symbol: REC8
  Gene Name: REC8 meiotic recombination protein
  Uniprot ID: O95072
  ENST ID: ENST00000620473
  CDS Start-End: 600-2243
actagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagta

SEQ ID NO: 174506 - DNA, 2217 bp, Homo sapiens
  Payload ID: 14261
  Gene Symbol: RTP1
  Gene Name: receptor (chemosensory) transporter protein 1
  Uniprot ID: P59025
  ENST ID: ENST00000312295
  CDS Start-End: 31-822
gctgggtcctgcttcctcctggtcttgtcgatgaggatttttagaccgtggagactgcgctgccctgccctgcacctaccctcactctccgtgttctcactaaggtggaaattgccttccctcactactgacgagaccatgtgtaaaagcgtgaccacagatgagtggaagaaagtcttctatgagaagatggaggaggcaaagccggctgacagctgggacctcatcatagaccccaacctcaagcacaatgtgctgagccctggttggaagcagtacctggaattgcatgcttcaggcaggttccactgctcctggtgctggcacacctggcagtcgccctacgtggtcatcctcttccacatgttcctggaccgcgcccagcgggcgggctcggtgcgcatgcgcgtcttcaagcagctgtgctatgagtgcggcacggcgcggctggacgagtccagcatgctggaggagaacatcgagggcctggtggacaacctcatcaccagcctgcgcgagcagtgctacggcgagcgtggcggccagtaccgcatccacgtggccagccgccaggacaaccggcggcaccgcggagagttctgcgaggcctgccaggagggcatcgtgcactggaagcccagcgagaagctgctggaggaggaggcgaccacctacaccttctcccgggcgcccagccccaccaagtcgcaggaccagacgggctcaggctggaacttctgctctatcccctggtgcttgttttgggccacggtcctgctgctgatcatctacctgcagttctctttccgtagctccgtataagattccgtggttgggcccagagcctgtcgagggtgccagttagctgatgcgagggtagaggagagacgtgggttgagaatagtgtaaacttctagcgctggtgatgtcactgactcagtggggatcttggacaaattatacagtttttccatctataaaactcagggtttgggcaagatcattggtttatcatagtgaaacccaggaccccaaagttctgcgtaggtgcctcagggacttttggatttggaaagtaggctaagctagtgggtgtctccaactcctgatctaaacacccatcctccaactcctacctcctcctcttgcttcgatcagaacagctttactttagatagggttccatttaagatttttgtaccaaaaaaaaaaaaaaaaaaagtttaactacttttaaaaagtttgaaaattagaggactgggtgatctcaaaagggctttccacagtaatgagctcgaccttgctcttattagtccctcacccctgcccctcatgatctcccactttctctagctgcagccttaaattagcttctttgcccaccctgtgagcctcatccgtgattctgccttcacacacgcagcagaggtttcccttgaagtgcaagaggtgggagatcaggctgttcctttgctgccaggtacacagggtctcttttttttgtttctcagattccagcttctttccactcagggcagattctggggtctgcctgcctgaaagatggtggttggggtggggtctcatagagttaggcttctcacccactgcgtattaactggcagagaatttaggggaggttcagaagacagagttttagaagcaaagcacaaaatctctgggaggcattataatggagggtcttcagagttcggggaccaagtctagcagattctcagcagtgctgatggccagaattcaggagcaggggcctggcctcctgggttctttgctgaaattatagttgaatggctttctcacattggccaagcatgaggcctcttgccaaagatcagctgtccccctaaagccacagggatggggtatcttcagcaagagagagggcgttaaagatgtaaaatgctttgtccatggggaagtgcacagatatgtgggagaaccttacaaggctctaaaatgagatgtgatatggcttgaaatgggaggagacactttctgacagtggggggtctggaatggaattggtggggacaggcagcaagctgcacttttgaggggcctcatttaccccacctctgttaaaaacttgactactctcctctttaatagaaagtcaccatcatctgtagtgatggaggaagggggtcacttatataaagatgggacactttaataaagacaggatatcttccataa

SEQ ID NO: 174507 - DNA, 1346 bp, Homo sapiens
  Payload ID: 14262
  Gene Symbol: RTP2
  Gene Name: receptor (chemosensory) transporter protein 2
  Uniprot ID: Q5QGT7
  ENST ID: ENST00000358241
  CDS Start-End: 430-1107
ctagggtgtcgtacttaccatagcacatgatgtggagaatgctagaagagcagttgggtgaagcagggccaccaaatagtccttgcctcctggagacctctggaaatccagatgagtgtggtctgaggttgggcctcccactgtgcttgctcctctcaggcctacccagcgctgcctctgaagcctaactcagggccctgaaactcccccttggggcttcccttctccccagccctcactcttggtgccctgcctggctaccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggaccatgtgtaccagcttgaccacttgtgagtggaagaaagtcttctatgagaagatggaggtggcaaagccagcggacagctgggagctcatcatagaccccaacctcaagcccagtgagctggcccctggctggaagcagtacctggagcagcacgcctcaggcaggttccactgctcctggtgctggcacacctggcagtctgcccatgtggtcatcctcttccacatgttcctggaccgcgcccagcgggcgggctcggtgcgcatgcgcgtcttcaagcagctgtgctatgagtgcggcacggcgcggctggacgagtccagcatgctggaggagaacatcgagggcctggtggacaacctcatcaccagcctgcgcgagcagtgctacgaggaggatggtggccagtaccgcatccacgtggccagccgcccggacagcgggccgcatcgtgcagagttctgtgaggcctgccaggagggcatcgttcactggaagcccagcgagaagctgctggaggaggaggtgaccacctacacctctgaagcctccaagccgagggcccaggcgggatccggctacaacttcttgtctcttcgctggtgcctcttctgggcctctctctgcctgctcgttgtttacctgcagttctccttcctcagtcctgccttcttttagtggagctggttaagggtgggagagggcacatgggcttgagagtggggaggacacagtctggacttgatcctgctacagattcaacatatgactggacaatccggtcacctctctgggcctcagttaatgcatctgcggaatgagaggattgcattagaagataggcaatgattctttcactggatgtgacaataattgggggaaggggaaaagggtgtaataaaggttttagagcttgc

SEQ ID NO: 174508 - DNA, 1321 bp, Homo sapiens
  Payload ID: 14263
  Gene Symbol: RTP3
  Gene Name: receptor (chemosensory) transporter protein 3
  Uniprot ID: Q9BQQ7
  ENST ID: ENST00000296142
  CDS Start-End: 573-1271
tttctcatgggtgggcagccttggctgtctgccggaacgtaaagagcatggagcaaggacatgggaatccgaatcccgctgaggtcccaggaccacttcatccttcttccctgtgcctctcctccccagcatgagcacagcagcctgatggagaaggattttccaatgttagaactggaaagaacacctgtagcctgtctccaccgtttacagtggtgctggaagtgaaaagatgtgttccaggtcacaggcaggtagacagcggagccagactgaaattcactcctcctgatttggagtttagagctcttctttggcaacattttgatgaataaaatcacaagttctgtgtcttttgaaattccttgtggagcctagtgccatcctctgaacttggagccaactgacctttgtccttggggcagagacatggttcatgggcccaatccaggtcctcaaagggagggcaggtctgagtccttgccctctgaagtcagaaacctcatctcccactacagacctgccagggcccaggagagctcgacccacccaggcacaccatagccccagagatggctggggacacagaagtgtggaagcaaatgtttcaggagttaatgcgggaggtgaagccatggcacaggtggaccctgagaccagacaagggccttcttcccaacgtcctgaagccaggctggatgcaataccagcagtggaccttcgccaggttccagtgctcctcctgctctcgtaactgggcctctgcccaagttctggtccttttccacatgaactggagtgaggagaagtccaggggccaggtgaagatgagggtgtttacccagagatgtaagaagtgcccccaacctctgtttgaggaccctgagttcacacaagagaacatctcaaggatcctgaaaaacctggtgttccgaattctgaagaaatgctatagaggaagatttcagttgatagaggaggttcctatgatcaaggacatctctcttgaagggccacacaatagtgacaactgtgaggcatgtctgcagggcttctgtgctgggcccatacaggttacaagcctccccccatctcagaccccaagagtacactccatttacaaggtggaggaggtagttaagccctgggcctcaggagagaatgtctattcctacgcatgccaaaaccacatctgtaggaacttaagcattttctgctgttgtgtcattctcattgttatcgtggtgattgttgtaaaaactgctatatgagccttggaaacatgaagctaagtcagaaaaaaaatcagatacaaaaagtc

SEQ ID NO: 174509 - DNA, 1554 bp, Homo sapiens
  Payload ID: 14264
  Gene Symbol: RTP4
  Gene Name: receptor (chemosensory) transporter protein 4
  Uniprot ID: Q96DX8
  ENST ID: ENST00000259030
  CDS Start-End: 111-851
gtccatacacagaaacagaaactgaaccgaacaccgaaactgaaactgtttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagccatcctctgaaaacagtatgaaacatgaccaagtacataatggatttagtaataaatattgtcgaattgctaaaaagtcttcaatcattcattcactaagtcactcagtgatatcaatatacttagctcagaaagtgtgggaggctgaataatggtgtctcccaacatatgcatgacttaatccccagaacctgtaaacatgttactttacatggtagaatggactttgcggatgtaattaaggaccttgaaatggttagattatttcatattgtccgggtggataagaaccaggattttgtaacagggaggcaacaagctcaaaatcagaaaaaagagatttgtcaatggaacaagaggttgaagtgctttgaagttggaggaagaggtcacaggcaaaaaagtacaggcagcctttagaaacccaaaaggacaaaggaacagattctcccctggagtctgcagaaggaaccagccctgcctgcacatggctttagcccagtgacactgattttggacatctgaccttcagaactgcttgctcataaacttgtcttgttttaatgca

SEQ ID NO: 174510 - DNA, 2296 bp, Homo sapiens
  Payload ID: 14265
  Gene Symbol: RTP5
  Gene Name: receptor (chemosensory) transporter protein 5 (putative)
  Uniprot ID: Q14D33
  ENST ID: ENST00000343216
  CDS Start-End: 29-1747
agcccacactgcggagccaggcggcagcatggaccgggctggggcagacatgtgggccagcaccttcaccctggccatggccgagaggaagccccaggacgtctgggttctgctacctgagcacagcctggtcccgggatgcctggacggcggtggtgtccagtacctgctggtggggctctcgaggctccagtgcggtcactgtccggggacctgggactcggcccatgtgcacgtcctcttccacctgtggtgggacagggccagccaccgggggctggtgaagatgcgcatctggggccagcggtgcaggctgtgccccgcacccggggactgccaggtgaggcccccgggcgagcagcccttcctcagcaggctggtcttgcacatcctgcaggactgctacggggatggccccggcccagcccggcaccccagggaggcctatgagggctgctgtgaggcctgtgagctgggggtctgcttcctccagaaggccccagaccccgcctggagcgccaacgccacaaaaggcaacttccccgccacggcctggggtggcactggcaccgtctccaggggcaaaccgctgtccacccctggcgacgaccttggcaagggtggcgttgtcatcgccatccccttctcccttgtgggtaccagcaatgaccaggtgcccatcgctgagggccctgccccccctgcgggggcctctctccctgtgactggcagctgtgaggccctggtcatcggccagggctccatcttcctgtctggggattcagtggccatgcctgggggcaaaggcttcccggtggccattggagaccccctcttccacggccccggcctcctcggcagcagcatccagaccttcgagctcaagggcttcctcttcaaaggccggggctccctctgcagcccggttggcgtggcccagggctggggccccatctccctcaacaatggcctcgtccctgtggggaaacacacgccaaccgtgttctactgtgtgggcctctcggccagcggggagggctccctcaccttcccctcctccctcaccagcatcttcaccaacaccctctcggagcccaccgatggccctgtggccactaaagaggcctccatcaccttccccttcatctttactgatgtcaaggatgccgttgctgaggtggctgaaggcaacgggaaggaaggaggcggccagggcctcgtcccagtgggtcacgacgccctgccagagaccaatgctggtggcctcccctcccaggtcaagggctcccttgccctccccttccctgctgatgtccaaggcaaagatgcctttactgacatcactgaaggcaaagagaaggaaggtggcctggtcaccgcgggtcacgacgcccctctggaggccaatgccgagggccccatcacggttagtgagggctgcatcaccatccccttcgcagtcttcgatgtcataaagcgcaagggcggtggccacgttgcctacggcccccagggcaatggctgcttctcccaaggctattaccagaagaggcagctgaggtccaggttccacaaggcccgctgtgggtgccgccgggaggaagacgagcgccctggccgtgcctgccgtaggccgcacgccgagccctacgaggacttctggatctgggtgtccatgaccgtgtgcgtcttctggctgatgtgcatgtgtcggctgaaccccgggatctacccgcagcaagtgtgacgccccgaagttcaggcaaccctcgcctctgggaccccgcctcgcctctgagacaccccccaaccccgcctttgagatgcccgccccgcctccgagaccccgcctccacctccgagacccctttctctgagacccccgcctctgaggccccgccccccgcctccgagaccccgccctgcctctgagaccccgcctcacctctgagacaccccccaaccccacctttgagatgcccgccccgcctccgtggccccgcctccacctccgagaccccgcctccacctccgagacccctttctctgagacccctgcctctgaagccccgccccccgcctccgagaccccgcttcacctccgaggccccgccccccgcctccgagaccccgccccccgcctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaagcca

SEQ ID NO: 174511 - DNA, 2602 bp, Homo sapiens
  Payload ID: 14265
  Gene Symbol: RTP5
  Gene Name: receptor (chemosensory) transporter protein 5 (putative)
  ENST ID: ENST00000419912
  CDS Start-End: 158-325
ttcctttctgcttcccatttctcggagacaaatctggttgccatggagaccatgctgttgtcaaggtggctgattggccggcgcgggatgcggggacgtttccttgggcccccggcgggcgcagccctcagcccacactgcggagccaggcggcagcatggaccgggctggggcagacatgtgggccagcaccttcaccctggccatggccgagaggaagccccaggacgtctgggttctgctacctgagcacagcctggtcccgggatgcctggacggcggtggtgtccagtacctgctggtggggctctcgagggttccctgaagctcacagctgcttgtgtggctagcaaatggtcaccggtctgatgaccgccatggacaagccaatccctcccagtgctctccccaaacctctcctcgcctggtgacgcccagcagggctgcccgggccatgaccgcaggcctccgtgacatccttcccctcagctggcaggctccagtgcggtcactgtccggggacctgggactcggcccatgtgcacgtcctcttccacctgtggtgggacagggccagccaccgggggctggtgaagatgcgcatctggggccagcggtgcaggctgtgccccgcacccggggactgccaggtgaggcccccgggcgagcagcccttcctcagcaggctggtcttgcacatcctgcaggactgctacggggatggccccggcccagcccggcaccccagggaggcctatgagggctgctgtgaggcctgtgagctgggggtctgcttcctccagaaggccccagaccccgcctggagcgccaacgccacaaaaggcaacttccccgccacggcctggggtggcactggcaccgtctccaggggcaaaccgctgtccacccctggcgacgaccttggcaagggtggcgttgtcatcgccatccccttctcccttgtgggtaccagcaatgaccaggtgcccatcgctgagggccctgccccccctgcgggggcctctctccctgtgactggcagctgtgaggccctggtcatcggccagggctccatcttcctgtctggggattcagtggccatgcctgggggcaaaggcttcccggtggccattggagaccccctcttccacggccccggcctcctcggcagcagcatccagaccttcgagctcaagggcttcctcttcaaaggccggggctccctctgcagcccggttggcgtggcccagggctggggccccatctccctcaacaatggcctcgtccctgtggggaaacacacgccaaccgtgttctactgtgtgggcctctcggccagcggggagggctccctcaccttcccctcctccctcaccagcatcttcaccaacaccctctcggagcccaccgatggccctgtggccactaaagaggcctccatcaccttccccttcatctttactgatgtcaaggatgccgttgctgaggtggctgaaggcaacgggaaggaaggaggcggccagggcctcgtcccagtgggtcacgacgccctgccagagaccaatgctggtggcctcccctcccaggtcaagggctcccttgccctccccttccctgctgatgtccaaggcaaagatgcctttactgacatcactgaaggcaaagagaaggaaggtggcctggtcaccgcgggtcacgacgcccctctggaggccaatgccgagggccccatcacggttagtgagggctgcatcaccatccccttcgcagtcttcgatgtcataaagcgcaagggcggtggccacgttgcctacggcccccagggcaatggctgcttctcccaaggctattaccagaagaggcagctgaggtccaggttccacaaggcccgctgtgggtgccgccgggaggaagacgagcgccctggccgtgcctgccgtaggccgcacgccgagccctacgaggacttctggatctgggtgtccatgaccgtgtgcgtcttctggctgatgtgcatgtgtcggctgaaccccgggatctacccgcagcaagtgtgacgccccgaagttcaggcaaccctcgcctctgggaccccgcctcgcctctgagacaccccccaaccccgcctttgagatgcccgccccgcctccgagaccccgcctccacctccgagacccctttctctgagacccccgcctctgaggccccgccccccgcctccgagaccccgccctgcctctgagaccccgcctcacctctgagacaccccccaaccccacctttgagatgcccgccccgcctccgtggccccgcctccacctccgagaccccgcctccacctccgagacccctttctctgagacccctgcctctgaagccccgccccccgcctccgagaccccgcttcacctccgaggccccgccccccgcctccgagaccccgccccccgcctccgagaccccgcctcacctctgagaccccgcccccgccagcagctcagcccctcctgtctcttgcccctggttttgtgggtctgccctgagctgtgcctgtgtgctccagcctcttcctatgtgtgtaacttcaataaaaccaagcaaa

SEQ ID NO: 174512 - DNA, 2296 bp, Homo sapiens; identical to SEQ ID NO: 174510
  Payload ID: 14265
  Gene Symbol: RTP5
  Gene Name: receptor (chemosensory) transporter protein 5 (putative)
  Uniprot ID: Q14D33
  ENST ID: ENST00000617264
  CDS Start-End: 29-1747

SEQ ID NO: 174513 - DNA, 2602 bp, Homo sapiens; identical to SEQ ID NO: 174511
  Payload ID: 14265
  Gene Symbol: RTP5
  Gene Name: receptor (chemosensory) transporter protein 5 (putative)
  ENST ID: ENST00000627567
  CDS Start-End: 158-325

SEQ ID NO: 174514 - DNA, 910 bp, Homo sapiens
  Payload ID: 14266
  Gene Symbol: RAMP1
  Gene Name: receptor (G protein-coupled) activity modifying protein 1
  Uniprot ID: O60894
  ENST ID: ENST00000254661
  CDS Start-End: 133-579
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaa

SEQ ID NO: 174515 - DNA, 857 bp, Homo sapiens
  Payload ID: 14266
  Gene Symbol: RAMP1
  Gene Name: receptor (G protein-coupled) activity modifying protein 1
  ENST ID: ENST00000404910
  CDS Start-End: 250-630
gcagctgccagagtgccaccaaagcaaacctcatctcaagactctgtggccaggccctcacaacctcctgccaggctctcgctacctacccatcaacagcaagactcccaggccatctcaatccccccaaagagccctgttcctccagccccacggcttctgttcacctgccgtgctgtccccgcctctgcccacccactcatcctgcagatctggagcagcattccagggcctgcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 174516 - DNA, 650 bp, Homo sapiens
  Payload ID: 14266
  Gene Symbol: RAMP1
  Gene Name: receptor (G protein-coupled) activity modifying protein 1
  ENST ID: ENST00000403885
  CDS Start-End: 43-423
ggagagcgggcattctggaaagcgtgggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 174517 - DNA, 734 bp, Homo sapiens
  Payload ID: 14266
  Gene Symbol: RAMP1
  Gene Name: receptor (G protein-coupled) activity modifying protein 1
  ENST ID: ENST00000409726
  CDS Start-End: 181-561
agtcctcagcggggcgcgtggcgagcggactcgactcggcaccgctgtgcaccatggcccgggccctgtgccgcctcccgcggcgcggcctctggctgctcctgggcaggatagcctgaggcacgcttgcttcactcccaggcagaatggccactgagaaatccggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctgg

SEQ ID NO: 174518 - DNA, 780 bp, Homo sapiens
  Payload ID: 14267
  Gene Symbol: RAMP2
  Gene Name: receptor (G protein-coupled) activity modifying protein 2
  Uniprot ID: O60895
  ENST ID: ENST00000253796
  CDS Start-End: 69-596
ggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttg

SEQ ID NO: 174519 - DNA, 573 bp, Homo sapiens
  Payload ID: 14267
  Gene Symbol: RAMP2
  Gene Name: receptor (G protein-coupled) activity modifying protein 2
  ENST ID: ENST00000588576
  CDS Start-End: 5-343
cacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaa

SEQ ID NO: 174520 - DNA, 549 bp, Homo sapiens
  Payload ID: 14267
  Gene Symbol: RAMP2
  Gene Name: receptor (G protein-coupled) activity modifying protein 2
  Uniprot ID: O60895
  ENST ID: ENST00000587142
  CDS Start-End: 5-547
cacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaagcatctgtacctacaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctaggg

SEQ ID NO: 174521 - DNA, 548 bp, Homo sapiens
  Payload ID: 14267
  Gene Symbol: RAMP2
  Gene Name: receptor (G protein-coupled) activity modifying protein 2
  ENST ID: ENST00000588928
  CDS Start-End: 400-548
cgagaggccgctggagctcccagccccctccctcttctccacgtctgggagagcagcttgccgacccctccagacccgaaagagagagggggcgactcgaattcggggagcgatcctgggagaccctggagagtcctgggcgccacgcagccgagcccccgaaatagatcccggttccggggttccgggagctgtccagcctcgcggggtgagctacgagagggtgggccaacgccggcgaggcggagggagccgcgggcgccaggcgcggctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcacca

SEQ ID NO: 174522 - DNA, 858 bp, Homo sapiens
  Payload ID: 14267
  Gene Symbol: RAMP2
  Gene Name: receptor (G protein-coupled) activity modifying protein 2
  ENST ID: ENST00000589683
  CDS Start-End: 367-669
cccaggacagccccttagaagcagcggcgtcgagaggccgctggagctcccagccccctccctcttctccacgtctgggagagcagcttgccgacccctccagacccgaaagagagagggggcgactcgaattcggggagcgatcctgggagaccctggagagtcctgggcgccacgcagccgagcccccgaaatagatcccggttccggggttccgggagctgtccagcctcgcgggctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttgtacaa

SEQ ID NO: 174523 - DNA, 1323 bp, Homo sapiens
  Payload ID: 14268
  Gene Symbol: RAMP3
  Gene Name: receptor (G protein-coupled) activity modifying protein 3
  Uniprot ID: O60896
  ENST ID: ENST00000242249
  CDS Start-End: 39-485
agcgggaccgagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcacagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 174524 - DNA, 543 bp, Homo sapiens
  Payload ID: 14268
  Gene Symbol: RAMP3
  Gene Name: receptor (G protein-coupled) activity modifying protein 3
  ENST ID: ENST00000496212
  CDS Start-End: 1-456
atggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctatgtggaaattgaggctcagaaatgtaaggggacttgctgaagagtggtcttttatattttcctggcctgctgccctactgaatccagccctgagaggtg

SEQ ID NO: 174525 - DNA, 559 bp, Homo sapiens
  Payload ID: 14268
  Gene Symbol: RAMP3
  Gene Name: receptor (G protein-coupled) activity modifying protein 3
  Uniprot ID: O60896
  ENST ID: ENST00000481345
  CDS Start-End: 1-447
atggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccgatgtggaaattgaggctcagaaatgtaaggggacttgctgaagagtggtcttttatattttcctggcctgctgccctactgaatccagccctgagaggtgacaa

SEQ ID NO: 174526 - DNA, 4160 bp, Homo sapiens
  Payload ID: 14269
  Gene Symbol: RIPK1
  Gene Name: receptor (TNFRSF)-interacting serine-threonine kinase 1
  Uniprot ID: Q13546
  ENST ID: ENST00000259808
  CDS Start-End: 299-2314
cggcggggcggcgctctcgcggtcctcctccccggcaagggccggggcagggggaggaggcagcgcgaacagtccacgccctccagccgggcgcgctcgacgcggacggcgggccagctgccggagcgcggcgactccaggggacccacagctggggcgccagagcgcggccatccgggcggggccgacggagcgcggcaggacttggctggacggcgcggccacggagaagggcgcgggtacagctctgccggggggggaaaaagtggtaccattttgggcgttcttgagcttcagaatgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccac

SEQ ID NO: 174527 - DNA, 3864 bp, Homo sapiens
  Payload ID: 14269
  Gene Symbol: RIPK1
  Gene Name: receptor (TNFRSF)-interacting serine-threonine kinase 1
  Uniprot ID: Q13546
  ENST ID: ENST00000380409
  CDS Start-End: 1-2016
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcggcctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaa

SEQ ID NO: 174528 - DNA, 3857 bp, Homo sapiens
  Payload ID: 14270
  Gene Symbol: REEP1
  Gene Name: receptor accessory protein 1
  Uniprot ID: Q9H902
  ENST ID: ENST00000165698
  CDS Start-End: 145-750
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaa

SEQ ID NO: 174529 - DNA, 578 bp, Homo sapiens
  Payload ID: 14270
  Gene Symbol: REEP1
  Gene Name: receptor accessory protein 1
  ENST ID: ENST00000453231
  CDS Start-End: 8-578
gtttcttatgcagaaagtgctgagcaacggacagactgaagaggttaggtctggatccaggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggcc

SEQ ID NO: 174530 - DNA, 546 bp, Homo sapiens
  Payload ID: 14270
  Gene Symbol: REEP1
  Gene Name: receptor accessory protein 1
  ENST ID: ENST00000428491
  CDS Start-End: 126-546
cagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccct

SEQ ID NO: 174531 - DNA, 440 bp, Homo sapiens
  Payload ID: 14270
  Gene Symbol: REEP1
  Gene Name: receptor accessory protein 1
  ENST ID: ENST00000437769
  CDS Start-End: 80-440
gggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcagg

SEQ ID NO: 174532 - DNA, 3778 bp, Homo sapiens
  Payload ID: 14270
  Gene Symbol: REEP1
  Gene Name: receptor accessory protein 1
  Uniprot ID: Q9H902
  ENST ID: ENST00000535845
  CDS Start-End: 153-677
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 174533 - DNA, 3735 bp, Homo sapiens
  Payload ID: 14270
  Gene Symbol: REEP1
  Gene Name: receptor accessory protein 1
  Uniprot ID: Q9H902
  ENST ID: ENST00000538924
  CDS Start-End: 8-634
gtttcttatgcagaaagtgctgagcaacggacagactgaagaggttaggtctggatccaggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 174534 - DNA, 3616 bp, Homo sapiens
  Payload ID: 14270
  Gene Symbol: REEP1
  Gene Name: receptor accessory protein 1
  Uniprot ID: Q9H902
  ENST ID: ENST00000541910
  CDS Start-End: 145-576
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 174535 - DNA, 958 bp, Homo sapiens
  Payload ID: 14270
  Gene Symbol: REEP1
  Gene Name: receptor accessory protein 1
  ENST ID: ENST00000489855
  CDS Start-End: 1-443
attcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaaggtactgtgctggaagtaccacaactacatgagtctcagtccctctagtgtgccctgctcatcacctgtgcgaccacacagaacaggctaaggaccaatcagtggtttttcatcttttaggggtccttttgaaaatctgatggaaaaaaatgctgaatcttgccccagaaaattctcaccccccaacacacatgcccacatacttgcaatatcaagaggttcccagagcccctgaagctcatctgtgcgtcccaggttaagaatttctaacttatccaaccccactggaaacaagaaaataatagaatttctaacttacttggcacttaggcctgggagaaacagaagagggcaggggagagagggagagagtgcttctctgcagtttcctagggtgcactgggagagtcgcctaaatgcagtggacaggtggagagactacctgagcaagcgggtggactcactcacgatcatgtggcccagcagatccaggggaaggaacccaggtcctagaataagttgagtggtccagacatggaggtcagtaatgtgccaagccataacaactgaagtggaggaggtttgaaataaacaccagtctgtggg

SEQ ID NO: 174536 - DNA, 2099 bp, Homo sapiens
  Payload ID: 14271
  Gene Symbol: REEP2
  Gene Name: receptor accessory protein 2
  Uniprot ID: Q9BRK0
  ENST ID: ENST00000254901
  CDS Start-End: 123-881
gctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 174537 - DNA, 2170 bp, Homo sapiens
  Payload ID: 14271
  Gene Symbol: REEP2
  Gene Name: receptor accessory protein 2
  Uniprot ID: Q9BRK0
  ENST ID: ENST00000378339
  CDS Start-End: 193-957
cacggcccgccgctgcggcagggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctc

SEQ ID NO: 174538 - DNA, 1021 bp, Homo sapiens
  Payload ID: 14271
  Gene Symbol: REEP2
  Gene Name: receptor accessory protein 2
  ENST ID: ENST00000506158
  CDS Start-End: 297-941
gctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgggctgatgcggagctgggagggagaggccactgcccttggctgagaggcccagtaaccatgcctgcctccctaggctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtg

SEQ ID NO: 174539 - DNA, 560 bp, Homo sapiens
  Payload ID: 14271
  Gene Symbol: REEP2
  Gene Name: receptor accessory protein 2
  ENST ID: ENST00000507511
  CDS Start-End: 99-221
actgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcag

SEQ ID NO: 174540 - DNA, 572 bp, Homo sapiens
  Payload ID: 14271
  Gene Symbol: REEP2
  Gene Name: receptor accessory protein 2
  ENST ID: ENST00000512126
  CDS Start-End: 1-572
agctcagagccatcaccaggccccttggtctctcccttccactcactgtcaggagactggggacgagggcatatgcccttaggccccctagggaggaagtctgggtatcgggaagcagaaatgctcggaggacaaagtgtgagaggctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatg

SEQ ID NO: 174541 - DNA, 1944 bp, Homo sapiens
  Payload ID: 14271
  Gene Symbol: REEP2
  Gene Name: receptor accessory protein 2
  ENST ID: ENST00000613650
  CDS Start-End: 83-538
gctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctc

SEQ ID NO: 174542 - DNA, 5205 bp, Homo sapiens
  Payload ID: 14272
  Gene Symbol: REEP3
  Gene Name: receptor accessory protein 3
  Uniprot ID: Q6NUK4
  ENST ID: ENST00000373758
  CDS Start-End: 184-951
gggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttaccttttttttttttttttttttgagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtatttggctaaaaaattatactgccaaaattactgattataaatacttgactacactgattgatgggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaattcgcgtttctttttttatgccagagtacatatgttggattccatgaattggtattacttattattatgtgttgattaaatatatgcacacacttaggattacagatcacagagcaaattatgaaaatcataaacattctggtatggtcatccataggattatgaaaaagaaatactgaattgttaaatttggatgttagaaaggaaagataggaaaaacaatgagtacagaaatcctcaccatcaatttggatgggttagctgtctcaggcataaaatgtaacacaaaattcagatttatgtatcctggaaatgttctggggttccatctgttttaaagttagacgtctgtctgcctcacatttaagctttagagagaaatcctatgttttaagaagtttctttgtgttacttcattatgacacataatgcgtgttaaggtctttctagatagcattttaaatggaattattttcattttcattatgaggtatatacttgtaatgatctaaagaggttagaaatataaataaaaattcaaaagaa

SEQ ID NO: 174543 - DNA, 560 bp, Homo sapiens
  Payload ID: 14272
  Gene Symbol: REEP3
  Gene Name: receptor accessory protein 3
  ENST ID: ENST00000634963
  CDS Start-End: 1-255
aagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaaggatttctggcttacttctgcacctctacttcaatcaatttgagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacg

SEQ ID NO: 174544 - DNA, 1710 bp, Homo sapiens
  Payload ID: 14273
  Gene Symbol: REEP4
  Gene Name: receptor accessory protein 4
  Uniprot ID: Q9H6H4
  ENST ID: ENST00000306306
  CDS Start-End: 470-1243
acactgcgcctgcgtggcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggc

SEQ ID NO: 174545 - DNA, 1476 bp, Homo sapiens
  Payload ID: 14273
  Gene Symbol: REEP4
  Gene Name: receptor accessory protein 4
  Uniprot ID: Q9H6H4
  ENST ID: ENST00000334530
  CDS Start-End: 372-893
gctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggc

SEQ ID NO: 174546 - DNA, 913 bp, Homo sapiens
  Payload ID: 14273
  Gene Symbol: REEP4
  Gene Name: receptor accessory protein 4
  ENST ID: ENST00000523293
  CDS Start-End: 59-814
gtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgcc

SEQ ID NO: 174547 - DNA, 635 bp, Homo sapiens
  Payload ID: 14273
  Gene Symbol: REEP4
  Gene Name: receptor accessory protein 4
  ENST ID: ENST00000521744
  CDS Start-End: 470-635
acactgcgcctgcgtggcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgagcgtgggggtttgggtgcggtggatgatgtactggattgtttttgcactcttcatgg

SEQ ID NO: 174548 - DNA, 683 bp, Homo sapiens
  Payload ID: 14274
  Gene Symbol: REEP5
  Gene Name: receptor accessory protein 5
  ENST ID: ENST00000261482
  CDS Start-End: 188-683
gggagaggactcgggaaaggtggagtcggagacagacgggacaagcagcatattcagggatcaggctggcctcccggaaagcgtgggcatcggaggaccccgcgggggctgcccaggctgagggtcgcggggctggagggcagctgcggcgccgggcgctggcagctggaagggccagcgctgacgtatgtctgccccgcggcccggcgccctattcctgctgtcctgcgcggtgggcgcggacggcggggcccctgcgggcgggcgcgttgacggaggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcga

SEQ ID NO: 174549 - DNA, 3326 bp, Homo sapiens
  Payload ID: 14274
  Gene Symbol: REEP5
  Gene Name: receptor accessory protein 5
  Uniprot ID: Q00765
  ENST ID: ENST00000379638
  CDS Start-End: 350-919
gtccgatttgagaaggggacccacgagagacacaaaatgcacgcccccacgccacatcctttttaccccgcaatgggttaagactgtcaacaggcaggccacctcgcagcgtccgcggagttgcaggcccgcccccgccagggtgtggcgctgtccccctggcgctgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactcgactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttatcacctatcctgaagatgtgatacactgaatggaaataaatagatgtaaataaaattgagttctcatttaactgtta

SEQ ID NO: 174550 - DNA, 1187 bp, Homo sapiens
  Payload ID: 14274
  Gene Symbol: REEP5
  Gene Name: receptor accessory protein 5
  ENST ID: ENST00000511865
  CDS Start-End: 1-436
ggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaaggtgtggtctggactagggtttctccttccccgctgcctgctgtagtagtggtcgtggtggcccatcttctccctcctctcggagttcttgccaaaggaggagccagtctgatctgaagacaagtagatgtctctattagcttcccagaattcattgttgggatttctgaacacatgaagaaagttgcagtgttttcctcttggacattgttgtatttcaaataaaccacaaatcgccattttccaccgggtcactgggcagaattcacattgcagctgtcgtcctgcataccatcgtccgttaaacagagaaagggctgcttggcattcttcttccgactggtactgaacatatacattgcccctcagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgt

SEQ ID NO: 174551 - DNA, 480 bp, Homo sapiens
  Payload ID: 14274
  Gene Symbol: REEP5
  Gene Name: receptor accessory protein 5
  ENST ID: ENST00000504247
  CDS Start-End: 100-399
agacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctctgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaag

SEQ ID NO: 174552 - DNA, 1139 bp, Homo sapiens
  Payload ID: 14274
  Gene Symbol: REEP5
  Gene Name: receptor accessory protein 5
  ENST ID: ENST00000513339
  CDS Start-End: 38-406
actaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaatacca

SEQ ID NO: 174553 - DNA, 1794 bp, Homo sapiens
  Payload ID: 14275
  Gene Symbol: REEP6
  Gene Name: receptor accessory protein 6
  Uniprot ID: Q96HR9
  ENST ID: ENST00000233596
  CDS Start-End: 524-1078
tccgataagcctcgccccgttcccgcccctaccattccgccctgcctcctttgtgatcagccccgccctccactggtctcgccaatgaatcgcgtcccgtttctccaatcggctcggatgtttctttagcccctccccccggttccgcccccccacgcctctcctcgccctggctccacccttcagccaataatcccatcctctgacaccgcccttccaatcagctacgtctcgctccggcccggccaatcggtgccctgggccgccgcgccccgccctctcccggcggggtctgggcagcggcggccgtggcggagggctatgcggcgggggagacggggcaggcccctcctcctttgtccgccctgccctcccattggtcctagcggggggccgggggcggacaccggcgcggggccggagcatcgcggctcaggctgcgggaaagcggtgcgcgtgcagcggggtgggtgccctggtccgcgggcgagctcgagcagccaaccccgggcgcgtcggggccatggacggcctgaggcagcgcgtggagcacttcctggagcaaaggaacctggtcaccgaagtgctgggggcgctggaggccaagaccggggtggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggcccccgtgcctgcagcactactggtgcctgaaacacctggcctgctaggaggctccaataaagctaacccggaccaga

SEQ ID NO: 174554 - DNA, 739 bp, Homo sapiens
  Payload ID: 14275
  Gene Symbol: REEP6
  Gene Name: receptor accessory protein 6
  ENST ID: ENST00000395479
  CDS Start-End: 1-452
gatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcttgcaggtcctggcccgtagccgggcaggcatcaccccggtggctgtggccgggccctccactcccctggaagctgacctcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagc

SEQ ID NO: 174555 - DNA, 611 bp, Homo sapiens
  Payload ID: 14275
  Gene Symbol: REEP6
  Gene Name: receptor accessory protein 6
  ENST ID: ENST00000395484
  CDS Start-End: 1-420
gctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcttgcaggtcctggcccgtagccgggcaggcatcaccccggtggctgtggccgggccctccactcccctggaagctgacctcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccacaacatccccacgcagccccccagcaagtcctctggcaagccggaggacgcagcccccaagaccagcggacagcgccaga

SEQ ID NO: 174556 - DNA, 5832 bp, Homo sapiens
  Payload ID: 14276
  Gene Symbol: ROR1
  Gene Name: receptor tyrosine kinase-like orphan receptor 1
  Uniprot ID: Q01973
  ENST ID: ENST00000371079
  CDS Start-End: 376-3189
gagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattggagtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggaaatgatgttcagaatccatgaagaaacttcaggccaaatttgaaaccctggagggaaatgagccataagggaagtataacaagccctgaagccttttatgtcgttgtgcttctttgggaaggtgtagagtgtgcctttttgtgaatcctcctctgatcatgagggtctttcccacagtttctcacagtgtgtttacactgcccttggaataacacagcgcatcagaccataagaaggctagatgtggatgctagaattgattgttggttgatagttctctttgctggattaggaatgaggcgccaaaggaagcacagccaggaaaatggccccacagcctagatcagcatctgtgggaaaggaaaaagggttcccatggggacagcccccataggagttttctggaaccagtaacactgaaaaataagtgtgtggctacagatgagcacgcccaccccttgcaactccctgtttacaagttgtccgaggcattggagtgcttatggtcaatgggctctagggaagtaggaaactccatcatgatacaaatgtctagtaattttaaagtttctttccctttttttctgtgctggaaatgttcacagatttgattcccgccccaagaattacaacaatgtattcatacagtcagttggaatccaaaggcaattaattctattttgcaaaatatgatggtcttcctaaaaaacaagtactgagttctcatttcaaaagttaccaagaactgaattctttaaactagcaaaccgaagtaacatgaccatttttgccttagtgggaggtttcaaatgtgcagctcatggcatttacctgccgaccatcttttgccaagtttagaattcttatgcgtttcaagttctatatagaaagtaattttacttttgatttttctcttgttaaaaaaaaactcctttattctaagaacaatgtctcaaagtctcatttttactttaaaggtataagagacttctaaagagacttacgggatataaaagtaattcctggaaatgatatttgatgaggagaatgtaagagaatgaaaaacacattgatgttttcatttttaaaaaatacaactagcatgagaaatcaagaaaatatgtttaccaaaatgcattgcaattttcccaaacctgagtcttcaaataacaaacatgaacttataggtactgtgaactagaagaattggttatatccagatttctgggagataaattaaaacatatttttgtggcataaataagctgattcagaagttacatttcttaactttaggtagaggagaatatttgtatccttttgttgctatgcaactgtttaatgatgaagcttcaaaccacaattttgtatatcatatgacaatcaattgttttccaagaatatttattattttaagtacacaatttcagtgaatcttgagtttttctaggagtcccttaaagggaaattagcattccatgagccagtaaaatacctactctggtaaaacattattatggttaaaaagtaaattcaagttagttttttataaagaactataacatttattttaaacattttataataactgaaaacattaaagtgagcaaatgaaatttcaaaaccacttgtaataatgtattttataatcgcactgtgatactatataacacagtctcttttgtattaaaatagtatttttttcacaagctgaaaaatatcttttcctttgttgacaatgttttgtaagatgactttattttcagatctttttctccttttttgcacaaaactatgcttatggtttgtgtcacagaagtgaaaatatatctttgcatttttatatctggtctgtttttcttgtttcctttgtttttaacttgatatagattttcttcaaatatataatggcaattttcagatatctcaccttaccatatctttccttattttcactgcatgcatttaatcactgtattacttaatgtttgatttgttattatgggcatttcaaataggcaagcattgaattgtaatgacaaaaaggctattttatattaaggatatatgcatttgtatttcacacaccagagatgatattaaacactgattattttatgctgctgtttattaaaaatgtttactataaaa

SEQ ID NO: 174557 - DNA, 2305 bp, Homo sapiens
  Payload ID: 14276
  Gene Symbol: ROR1
  Gene Name: receptor tyrosine kinase-like orphan receptor 1
  Uniprot ID: Q01973
  ENST ID: ENST00000371080
  CDS Start-End: 397-1578
gagcgagagagggagcgtggagagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcggtaaatagaagtcattgcccctaatgtattcaatcatctttaaagatccctatcctacccctcttatttaggagaatcctataaggggggcaaagaaaatggacagtatttgcttgatctcaatctggttttagggtaaaccttgccgtttctacataaaacacctcgtaaggtaccaaaacacgttctcaagaagtcaactgcctttatacctgcagccattgcactcatggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggacaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctaccaaaaaaaagaaaaaaaaaaaaagaaaa

SEQ ID NO: 174558 - DNA, 5362 bp, Homo sapiens
  Payload ID: 14276
  Gene Symbol: ROR1
  Gene Name: receptor tyrosine kinase-like orphan receptor 1
  ENST ID: ENST00000545203
  CDS Start-End: 77-2725
agaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattggagtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggaaatgatgttcagaatccatgaagaaacttcaggccaaatttgaaaccctggagggaaatgagccataagggaagtataacaagccctgaagccttttatgtcgttgtgcttctttgggaaggtgtagagtgtgcctttttgtgaatcctcctctgatcatgagggtctttcccacagtttctcacagtgtgtttacactgcccttggaataacacagcgcatcagaccataagaaggctagatgtggatgctagaattgattgttggttgatagttctctttgctggattaggaatgaggcgccaaaggaagcacagccaggaaaatggccccacagcctagatcagcatctgtgggaaaggaaaaagggttcccatggggacagcccccataggagttttctggaaccagtaacactgaaaaataagtgtgtggctacagatgagcacgcccaccccttgcaactccctgtttacaagttgtccgaggcattggagtgcttatggtcaatgggctctagggaagtaggaaactccatcatgatacaaatgtctagtaattttaaagtttctttccctttttttctgtgctggaaatgttcacagatttgattcccgccccaagaattacaacaatgtattcatacagtcagttggaatccaaaggcaattaattctattttgcaaaatatgatggtcttcctaaaaaacaagtactgagttctcatttcaaaagttaccaagaactgaattctttaaactagcaaaccgaagtaacatgaccatttttgccttagtgggaggtttcaaatgtgcagctcatggcatttacctgccgaccatcttttgccaagtttagaattcttatgcgtttcaagttctatatagaaagtaattttacttttgatttttctcttgttaaaaaaaaactcctttattctaagaacaatgtctcaaagtctcatttttactttaaaggtataagagacttctaaagagacttacgggatataaaagtaattcctggaaatgatatttgatgaggagaatgtaagagaatgaaaaacacattgatgttttcatttttaaaaaatacaactagcatgagaaatcaagaaaatatgtttaccaaaatgcattgcaattttcccaaacctgagtcttcaaataacaaacatgaacttataggtactgtgaactagaagaattggttatatccagatttctgggagataaattaaaacatatttttgtggcataaataagctgattcagaagttacatttcttaactttaggtagaggagaatatttgtatccttttgttgctatgcaactgtttaatgatgaagcttcaaaccacaattttgtatatcatatgacaatcaattgttttccaagaatatttattattttaagtacacaatttcagtgaatcttgagtttttctaggagtcccttaaagggaaattagcattccatgagccagtaaaatacctactctggtaaaacattattatggttaaaaagtaaattcaagttagttttttataaagaactataacatttattttaaacattttataataactgaaaacattaaagtgagcaaatgaaatttcaaaaccacttgtaataatgtattttataatcgcactgtgatactatataacacagtctcttttgtattaaaatagtatttttttcacaagctgaaaaatatcttttcctttgttgacaatgttttgtaagatgactttattttcagatctttttctccttttttgcacaaaactatgcttatggtttgtgtcacagaagtgaaaatatatctttgcatttttatatctggtctgtttttcttgtttcctttgtttttaacttgatatagattttcttcaaatatataatggcaattttcagatatctcaccttaccatatctttccttattttcactgcatgcatttaatcactgtattacttaatgtttgatttgttattatgggcatttcaaataggcaagcattgaattgtaatgacaaaaaggctattttatattaaggatatatgcatttgtatttcacacaccagagatgatattaaacactgattattttatgctgctgtttattaaaaatgtttact

SEQ ID NO: 174559 - DNA, 4096 bp, Homo sapiens
  Payload ID: 14277
  Gene Symbol: ROR2
  Gene Name: receptor tyrosine kinase-like orphan receptor 2
  Uniprot ID: Q01974
  ENST ID: ENST00000375708
  CDS Start-End: 200-3031
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagcatgtg

SEQ ID NO: 174560 - DNA, 2993 bp, Homo sapiens
  Payload ID: 14277
  Gene Symbol: ROR2
  Gene Name: receptor tyrosine kinase-like orphan receptor 2
  ENST ID: ENST00000375715
  CDS Start-End: 598-2712
cgggccggattctcggcaccctgcgggggtggaggagggcgggcggggccttcaggcccaggagcgccagagacctatggggttcgcctgaagcccccggaatgtgtgagacacttcttactagtaaatgggcttcagtatcccccatccctgcactcctgcaggaaggtgagaatcgggacagtcgcaggctgggagacgctctgcttttcctgcgtcctgctgggagctgcgcgctccaggtatcctggcctgccgccctagccggcccaaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgttgtaaggatgcgaggcagcgggaggcagtgctggatgacggagacgccaaacgctttgttgtggcataatgtgtctggagttggttcctgccggtgggttcgtggtctcgctgacttcaaggatgaagccaccgactttcgcgttatgccacgggaccccagcctgcactgccatgtgacttcaaccgcatgacagaccctgggcccagagcactcagactcatgaacaaaatagattcagcattcccatatttgaaatgggaagaagtttcatgtccattctggcttcatgtggttggaagaggaagccccatgaatatttttatggatgccccagtgctgttgagtgcctatcaacaccaccacgagcttggccacttcacatcaacagcagatttaatttgggatctctaaacactatttgtggttgtgtagacagaaagaatttttctaataaaataaaaattaaatgtg

SEQ ID NO: 174561 - DNA, 1452 bp, Homo sapiens
  Payload ID: 14278
  Gene Symbol: RAPSN
  Gene Name: receptor-associated protein of the synapse
  Uniprot ID: Q13702
  ENST ID: ENST00000352508
  CDS Start-End: 180-1241
cagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctgg

SEQ ID NO: 174562 - DNA, 1671 bp, Homo sapiens
  Payload ID: 14278
  Gene Symbol: RAPSN
  Gene Name: receptor-associated protein of the synapse
  Uniprot ID: Q13702
  ENST ID: ENST00000298854
  CDS Start-End: 215-1453
cccaactggcagcgacagctgcagacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagacagccttccccaggtacgactccgccatgagcatcatgaccgagatcggaaaccgcctggggcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggtcccagg

SEQ ID NO: 174563 - DNA, 1408 bp, Homo sapiens
  Payload ID: 14278
  Gene Symbol: RAPSN
  Gene Name: receptor-associated protein of the synapse
  ENST ID: ENST00000529341
  CDS Start-End: 173-1234
gttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgggggctcctgggggggtggacaggggtgggcaggatctcttcggggcactctagggcccagctggcttaatcacagcaataatactaatagcaaacacttaaccttggccaggcgtggtgcctcacgtctgtctcgcaagcactttgggaggccgaggcgggctgatcacttgagccccggggttcaagatcatcttggccaacatggtgaaaccccgtctctactaaaaatacaaaaattacc

SEQ ID NO: 174564 - DNA, 1462 bp, Homo sapiens
  Payload ID: 14278
  Gene Symbol: RAPSN
  Gene Name: receptor-associated protein of the synapse
  ENST ID: ENST00000524487
  CDS Start-End: 173-1252
gttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggagtctatgaagatcgcgctgcagcacggggaccggccactgcaggcgctctgcctgctctgcttcgctgacatccaccggagccgtggggacctggagacagccttccccaggtacgactccgccatgagcatcatgaccgagatcggaaaccgcctggggcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctg

SEQ ID NO: 174565 - DNA, 2584 bp, Homo sapiens
  Payload ID: 14279
  Gene Symbol: RIPK2
  Gene Name: receptor-interacting serine-threonine kinase 2
  Uniprot ID: O43353
  ENST ID: ENST00000220751
  CDS Start-End: 315-1937
gagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgt

SEQ ID NO: 174566 - DNA, 572 bp, Homo sapiens
  Payload ID: 14279
  Gene Symbol: RIPK2
  Gene Name: receptor-interacting serine-threonine kinase 2
  ENST ID: ENST00000517696
  CDS Start-End: 245-457
tttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagggatttaactaggcccagcattcagttcttagtgagttaacatccatgattacaacattctcttctcctcctcctatatctaatgtgaaaatacgtcatccccgatgcctgattggccagaagcttgaaagaaaggatgtcttaagagaagctga

SEQ ID NO: 174567 - DNA, 1916 bp, Homo sapiens
  Payload ID: 14279
  Gene Symbol: RIPK2
  Gene Name: receptor-interacting serine-threonine kinase 2
  ENST ID: ENST00000522965
  CDS Start-End: 256-462
agaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacat

SEQ ID NO: 174568 - DNA, 1930 bp, Homo sapiens
  Payload ID: 14280
  Gene Symbol: RIPK3
  Gene Name: receptor-interacting serine-threonine kinase 3
  Uniprot ID: Q9Y572
  ENST ID: ENST00000216274
  CDS Start-End: 220-1776
accccaggggcgggactgtagaggcgcctataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagttgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctagtca

SEQ ID NO: 174569 - DNA, 587 bp, Homo sapiens
  Payload ID: 14280
  Gene Symbol: RIPK3
  Gene Name: receptor-interacting serine-threonine kinase 3
  ENST ID: ENST00000554569
  CDS Start-End: 1-488
caggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacaggtacccattctctacctctttcttttccctgttcaattcttccaccagactcctcctccagacctatatctagattcagggtactttgtggaggggaggggagaagatgatctaactcaaccttctcatttcataaatgggaaaaccgacaccccctgagaaaggagccctctgaggtcacacaacaaagcttggatttgtccctgaat

SEQ ID NO: 174570 - DNA, 1758 bp, Homo sapiens
  Payload ID: 14280
  Gene Symbol: RIPK3
  Gene Name: receptor-interacting serine-threonine kinase 3
  Uniprot ID: Q9Y572
  ENST ID: ENST00000554756
  CDS Start-End: 164-859
aaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagtgtaagactctaggaggattctgggatccttaaccccagtgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataa

SEQ ID NO: 174571 - DNA, 4016 bp, Homo sapiens
  Payload ID: 14281
  Gene Symbol: RIPK4
  Gene Name: receptor-interacting serine-threonine kinase 4
  Uniprot ID: P57078
  ENST ID: ENST00000352483
  CDS Start-End: 49-2547
gcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggaaacgggctgaatggggagctcatccgccaggtgctggcagctctgctccctgtgactggcaggtggcgctcccccggggaaggcttccgccttgagtctgaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctg

SEQ ID NO: 174572 - DNA, 3889 bp, Homo sapiens
  Payload ID: 14281
  Gene Symbol: RIPK4
  Gene Name: receptor-interacting serine-threonine kinase 4
  Uniprot ID: P57078
  ENST ID: ENST00000332512
  CDS Start-End: 66-2420
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctg

SEQ ID NO: 174573 - DNA, 586 bp, Homo sapiens
  Payload ID: 14282
  Gene Symbol: RYK
  Gene Name: receptor-like tyrosine kinase
  ENST ID: ENST00000486725
  CDS Start-End: 1-280
caaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctga

SEQ ID NO: 174574 - DNA, 2667 bp, Homo sapiens
  Payload ID: 14282
  Gene Symbol: RYK
  Gene Name: receptor-like tyrosine kinase
  ENST ID: ENST00000460933
  CDS Start-End: 1-1647
agcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatta

SEQ ID NO: 174575 - DNA, 2942 bp, Homo sapiens
  Payload ID: 14282
  Gene Symbol: RYK
  Gene Name: receptor-like tyrosine kinase
  ENST ID: ENST00000620660
  CDS Start-End: 91-1923
cggctcggggctgtgagcggctcggggccgggggtgggcggcggtgcggcgggcggccgacgctcctcttcggcggcggcggcggcggccatgcgtggggcggcgcggctggggcggccgggccggagttgcctcccgggggcccgcggcctgagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 174576 - DNA, 2934 bp, Homo sapiens
  Payload ID: 14282
  Gene Symbol: RYK
  Gene Name: receptor-like tyrosine kinase
  ENST ID: ENST00000623711
  CDS Start-End: 91-1914
cggctcggggctgtgagcggctcggggccgggggtgggcggcggtgcggcgggcggccgacgctcctcttcggcggcggcggcggcggccatgcgtggggcggcgcggctggggcggccgggccggagttgcctcccgggggcccgcggcctgagggccccgccgccgccgccgctgctgcttctgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatta

SEQ ID NO: 174577 - DNA, 1258 bp, Homo sapiens
  Payload ID: 14282
  Gene Symbol: RYK
  Gene Name: receptor-like tyrosine kinase
  ENST ID: ENST00000484106
  CDS Start-End: 1-474
gaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtggctccaccatgcggtgccgctctctttggagtctcctgaaggggaggagggccctcttggctgctcttctgactccaacagctggatgaagcctattcttgtcctacaggagccccactggaagtgaataagctcagttgccatatttggaccaaaattctcacatttgatactggaaggggtgaaaagagacctgttcaggggcagtgcccagtgaggagaccctcaaacgagaggcagagtccctcaagcctttgtacaatgccaccaagggtgctgccccttcttcaacagaacgtcctccttgcagggaggctgcagtgatgtcagagatgaatcacaggccagaggtgagagctggagaaagggaaactctcccagtccctgggagtggtcattacagactgggaaatcgctctccagctgatggtaaaggactgcaaatcctattcatgtgactcagggcctggtgtgccttctgggaagaaagcagaagagggttcctaactgtagaagggaaaagtttccctttattcttccagccacgtggttcaataagcatgtacaagctcttaccagggccaggcactgtgcgggcaccagaaacattaagatggaatgacacaggtctgccctggaagaaacattaagatggaatgacacaggtctgccctggaagggctcctttccagggctcagggactctgtgactccttttggggagcagagttgtggacaagagtgcatttttctagagagatggtccacaagccatccagagccaggctctgtctccaggtacccttgatccttggagacctcc

SEQ ID NO: 174578 - DNA, 6564 bp, Homo sapiens
  Payload ID: 14283
  Gene Symbol: RAG1
  Gene Name: recombination activating gene 1
  Uniprot ID: P15918
  ENST ID: ENST00000299440
  CDS Start-End: 113-3244
gagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcacaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccaggaaagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcaagtttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagttttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagccttttttttttttgtatttcagagaaaattcaggtaccaggatgcaatggatttatttgattcaggggacctgtgtttccatgtcaaatgttttcaaataaaatgaaatatgagtttcaatactttttatattttaatatttccattcattaatattatggttattgtcagcaattttatgtttgaatatttgaaataaaagtttaagatt

SEQ ID NO: 174579 - DNA, 3707 bp, Homo sapiens
  Payload ID: 14283
  Gene Symbol: RAG1
  Gene Name: recombination activating gene 1
  Uniprot ID: P15918
  ENST ID: ENST00000534663
  CDS Start-End: 637-3432
gttaatgaagccaaagaagcacatgaaaggatatttctgaatacaggattctggccttaaaatacactgagtgcaatctgaagccacttcaaagaatcaccttgttttcttgctgacattgcagtggggacgatgagacccaaggacattcagccaagagggaaatatctgctagaccaggtggatatctatcaagttctctttctttcctgcagagttaactagacatccgtgttcctggatctcaggacttcgggcttggactgaattacactacggattttcctggttctccagcttgaagacagcagattgtgggacttcttgacctccataattgtgatccaagggaggtcttacttctcaataggagacaagtgacttgatttcaacacggatgggagaaattgggaggtgaaattgggagaaacatggaaatactggggaagcatgaacatctggccttttctttttcttcctgtaagtccattggagatgcaagattttaaggagcaggaggatggggggggaaggacaccctcttgcatgttgcaggtgatgagattgaagttcctaaagtttaagtaatgaatcaaaggcctgagtcaagatttaaatccaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcacaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtatagaaattaaatccatctttaatgaagaaagaggtacagctgttgaacatcttcaagggaatgaatcatggattctgaaggtgattgattgaaatgtgtcaaattcatcatcaccatcaaaactatttgcttctgcactgaaacaaaattcttcagagtcttcaaagggagtggaatcccctggatcttctgttgatgtttgactgtttgtgaatgttgtctgctcttcattagtatcatcttcagcacatttcaacatatagaaatagaatccttctgaaacaa

SEQ ID NO: 174580 - DNA, 2388 bp, Homo sapiens
  Payload ID: 14284
  Gene Symbol: RAG2
  Gene Name: recombination activating gene 2
  Uniprot ID: P55895
  ENST ID: ENST00000311485
  CDS Start-End: 163-1746
actctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaa

SEQ ID NO: 174581 - DNA, 554 bp, Homo sapiens
  Payload ID: 14284
  Gene Symbol: RAG2
  Gene Name: recombination activating gene 2
  ENST ID: ENST00000532616
  CDS Start-End: 137-139
actctctttacagtcagccttctgcttgccacagtcatagtgggcagtcagtgaatcttccccaagtgctgacaattaatacctggtttagcggcaaagattcagagaggcgtgagcagcccctctggccttcagaatgaagatgaaaagaagatgtgtttaggaaccttctctgcttccctaaaagaaccctaaaaacaggagtaaaaacagtgaagaaaacaaaggaccttcaaagtgcactcgttaaaacctaataactgtatttctattactaaatgtagaagtggtaaacatctttaacaggcaatgtctcccctgcactctagggattcaaagatccatctttcggttctgtaagacagtcacggcttttgtaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactatg

SEQ ID NO: 174582 - DNA, 572 bp, Homo sapiens
  Payload ID: 14284
  Gene Symbol: RAG2
  Gene Name: recombination activating gene 2
  ENST ID: ENST00000529083
  CDS Start-End: 121-572
aaaagtccccaggagaggctccagcaataccagggtagcggtttgcccgacaccgctccgggcgctgcagccttccggcaacccggacgttggacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaag

SEQ ID NO: 174583 - DNA, 569 bp, Homo sapiens
  Payload ID: 14284
  Gene Symbol: RAG2
  Gene Name: recombination activating gene 2
  ENST ID: ENST00000527033
  CDS Start-End: 358-569
actctctttacagtcagccttctgcttgccacagtcatagtgggcagtcagtgaatcttccccaagtgctgacaattaatacctggtttagcggcaaagattcagagaggcgtgagcagcccctctggccttcagggattcaaagatccatctttcggttctgtaagacagtcacggcttttgtaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcc

SEQ ID NO: 174584 - DNA, 2818 bp, Homo sapiens
  Payload ID: 14284
  Gene Symbol: RAG2
  Gene Name: recombination activating gene 2
  Uniprot ID: P55895
  ENST ID: ENST00000618712
  CDS Start-End: 595-2178
attagatcagtgttcataagaacatctgtaggcacacatacacactctctttacagtcagccttctgcttgccacagtcatagtgggcagtcagtgaatcttccccaagtgctgacaattaatacctggtttagcggcaaagattcagagaggcgtgagcagcccctctggccttcagaatgaagatgaaaagaagatgtgtttaggaaccttctctgcttccctaaaagaaccctaaaaacaggagtaaaaacagtgaagaaaacaaaggaccttcaaagtgcactcgttaaaacctaataactgtatttctattactaaatgtagaagtggtaaacatctttaacaggcaatgtctcccctgcactctagggattcaaagatccatctttcggttctgtaagacagtcacggcttttgtaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatc

SEQ ID NO: 174585 - DNA, 1682 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000345843
  CDS Start-End: 166-1623
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaa

SEQ ID NO: 174586 - DNA, 1752 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000348160
  CDS Start-End: 230-1693
atgctccatcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaa

SEQ ID NO: 174587 - DNA, 5761 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000342320
  CDS Start-End: 177-1637
tgtttttaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaa

SEQ ID NO: 174588 - DNA, 5860 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000342295
  CDS Start-End: 237-1739
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgt

SEQ ID NO: 174589 - DNA, 5990 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000355476
  CDS Start-End: 409-1869
atcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgt

SEQ ID NO: 174590 - DNA, 1697 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000361572
  CDS Start-End: 195-1697
acccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaa

SEQ ID NO: 174591 - DNA, 405 bp, Homo sapiens
  Payload ID: 14285
  Gene Symbol: RBPJ
  Gene Name: recombination signal binding protein for immunoglobulin kappa J region
  ENST ID: ENST00000504423
  CDS Start-End: 1-405
ataattaggaaagttgataagcagaccgcattattggatgcagatgatcctgtgtcacaactccataaatgtgcattttaccttaaggatacagaaagaatgtatttgtgcctttctcaagaaagaataattcaatttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccaggg

SEQ ID NO: 174592 - DNA, 607 bp, Homo sapiens
  Payload ID: 14285
  Gene Symbol: RBPJ
  Gene Name: recombination signal binding protein for immunoglobulin kappa J region
  ENST ID: ENST00000507574
  CDS Start-End: 136-607
ttagaaggaggctcaagatgtatatatgtgtttttctgttagtgtttgagaatagtttcagatagccacaatggatattcatttggcgtgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgac

SEQ ID NO: 174593 - DNA, 572 bp, Homo sapiens
  Payload ID: 14285
  Gene Symbol: RBPJ
  Gene Name: recombination signal binding protein for immunoglobulin kappa J region
  ENST ID: ENST00000511546
  CDS Start-End: 252-572
gagcgggccggggcgggcgtggcgtgggtgtgccaggagctccgcggttgccgcgaagcgagctggagctgaccctcggcgtccctcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaac

SEQ ID NO: 174594 - DNA, 698 bp, Homo sapiens
  Payload ID: 14285
  Gene Symbol: RBPJ
  Gene Name: recombination signal binding protein for immunoglobulin kappa J region
  ENST ID: ENST00000515573
  CDS Start-End: 131-698
gtgtttgttattgtgaatccctaagggtgactgttttttcagcagggcgagttaggacggcacaaactgagagtttctgttctggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctct

SEQ ID NO: 174595 - DNA, 578 bp, Homo sapiens
  Payload ID: 14285
  Gene Symbol: RBPJ
  Gene Name: recombination signal binding protein for immunoglobulin kappa J region
  ENST ID: ENST00000514675
  CDS Start-End: 248-578
tatatttaccaggattactatgctgaaggtattcttcaagagtttgttttttttctactggttgatctctacttttagaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacag

SEQ ID NO: 174596 - DNA, 795 bp, Homo sapiens
  Payload ID: 14285
  Gene Symbol: RBPJ
  Gene Name: recombination signal binding protein for immunoglobulin kappa J region
  ENST ID: ENST00000512671
  CDS Start-End: 261-795
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgact

SEQ ID NO: 174597 - DNA, 1682 bp, Homo sapiens
  Payload ID: 14285
  Gene Symbol: RBPJ
  Gene Name: recombination signal binding protein for immunoglobulin kappa J region
  ENST ID: ENST00000504907
  CDS Start-End: 177-1325
tgtttttaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaag

SEQ ID NO: 174598 - DNA, 1689 bp, Homo sapiens
  Payload ID: 14285
  Gene Symbol: RBPJ
  Gene Name: recombination signal binding protein for immunoglobulin kappa J region
  Uniprot ID: Q06330
  ENST ID: ENST00000507561
  CDS Start-End: 116-1513
agcccagtgacctgccacagcccgggcaccagatttctgccttaattgttcttccattgtctttctcctgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacag

SEQ ID NO: 174599 - DNA, 731 bp, Homo sapiens
  Payload ID: 14285
  Gene Symbol: RBPJ
  Gene Name: recombination signal binding protein for immunoglobulin kappa J region
  ENST ID: ENST00000504938
  CDS Start-End: 302-731
tacagatacactggctgaggtgttttgaggtgcatcgaagtgttccaagctgtgacttaccttaacatgttcttgaagtaccatggcgtggattaaaagggtcttgctctgtcatccaggctagagtggactggtgcgatctcagctcactgcagcctcgacttcctggactcaatcttgcttcaaggtctttttcaagtgctgtgtcttcactgtctcagaagtttacacttcctatttcagaggaaataacaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgact

SEQ ID NO: 174600 - DNA, 609 bp, Homo sapiens
  Payload ID: 14285
  Gene Symbol: RBPJ
  Gene Name: recombination signal binding protein for immunoglobulin kappa J region
  ENST ID: ENST00000512351
  CDS Start-End: 327-609
ttcattctgacatttttacttcctttgttgccaggcaaagtggccaccagattgggtggaaggggctctttctacggcatttcatgactgagcctccaagaacaacctgtattgagtttctctttgagatgattggactgctctatccagcatcattgagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtg

SEQ ID NO: 174601 - DNA, 555 bp, Homo sapiens
  Payload ID: 14285
  Gene Symbol: RBPJ
  Gene Name: recombination signal binding protein for immunoglobulin kappa J region
  ENST ID: ENST00000509158
  CDS Start-End: 409-555
atcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaa

SEQ ID NO: 174602 - DNA, 340 bp, Homo sapiens
  Payload ID: 14285
  Gene Symbol: RBPJ
  Gene Name: recombination signal binding protein for immunoglobulin kappa J region
  ENST ID: ENST00000514807
  CDS Start-End: 196-340
gagccgcctgcgcatgctccatcgcctggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatg

SEQ ID NO: 174603 - DNA, 569 bp, Homo sapiens
  Payload ID: 14285
  Gene Symbol: RBPJ
  Gene Name: recombination signal binding protein for immunoglobulin kappa J region
  ENST ID: ENST00000514730
  CDS Start-End: 231-569
gcaatctaggctgcctgaggatgattggagggtatcgtaggacggttagaaggaggctcaagattcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaaca

SEQ ID NO: 174604 - DNA, 566 bp, Homo sapiens
  Payload ID: 14285
  Gene Symbol: RBPJ
  Gene Name: recombination signal binding protein for immunoglobulin kappa J region
  ENST ID: ENST00000506956
  CDS Start-End: 276-566
agtggaaggcggtgggaaggaggtgtagcgtgagactggactgcccgcattgggtacatgcgcagtgccgctcgcgcgggccgcgccaatcctgcagcgccttcaacagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaa

SEQ ID NO: 174605 - DNA, 758 bp, Homo sapiens
  Payload ID: 14285
  Gene Symbol: RBPJ
  Gene Name: recombination signal binding protein for immunoglobulin kappa J region
  ENST ID: ENST00000505958
  CDS Start-End: 674-758
gggggccccgtgcatctttgttcctcgcggccgttgtcgccgcttcgccccgctagtgcccccggccccgggcgctttgtctttcaccgctacccgctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgtatggtcctggatcaccccccgaggctttgtctcccccatccacgggcttattctctcggcacccccttcctctcccgtcatcggttgatttatccacaacccacggtgtacgtctgctgaactgtctcagccccggggactccatctgctgcttctaagtgcacacaagactctacgtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagc

SEQ ID NO: 174606 - DNA, 716 bp, Homo sapiens
  Payload ID: 14285
  Gene Symbol: RBPJ
  Gene Name: recombination signal binding protein for immunoglobulin kappa J region
  ENST ID: ENST00000510778
  CDS Start-End: 28-716
aaaacaaaactacagatttggttgcagatgaacttgcattttgtcttcattttttccaaagtgattcattcttcctggttcttgaacacctgcttaaaaatagggcttacttttctctgtccttggggtgcaccaaccatatttgaaaccatgaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaagg

SEQ ID NO: 174607 - DNA, 537 bp, Homo sapiens
  Payload ID: 14285
  Gene Symbol: RBPJ
  Gene Name: recombination signal binding protein for immunoglobulin kappa J region
  ENST ID: ENST00000513182
  CDS Start-End: 23-184
ttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtgttagtagtaaaggactgctaatgctaatctagccctctggatgtctgtcaaactgccctggattcagagaagtgttctgggctcttacttggtggtggagtgcacagtgggaagaggatctgtcttctttcttgccgatcctggttcaggcctttttgaagagttgcaaaggcgtaaggcgtgaggttacctgggggcatgatcacagtcctcttggctgtgtctttttggcatacaaaataactccagtttttttgcccacctccttgtgtatatcttatgggcagtggatggaagaaaaaaaaagaacaaatggaacgcgatggttgttctgaacaagagtctcaaccgtgtgca

SEQ ID NO: 174608 - DNA, 2489 bp, Homo sapiens
  Payload ID: 14286
  Gene Symbol: RBPJL
  Gene Name: recombination signal binding protein for immunoglobulin kappa J region-like
  Uniprot ID: Q9UBG7
  ENST ID: ENST00000343694
  CDS Start-End: 73-1626
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttagtctacagacctatgtgcgtgtccctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccgggtctctctaagtctcacctggggaattcggtcccacctggggcaccagttcccacctagagcactgtgtcctgccctagagcacaaagacctgctcctcccgagactctctctgactgcagccaggcatagtacctttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatcc

SEQ ID NO: 174609 - DNA, 1636 bp, Homo sapiens
  Payload ID: 14286
  Gene Symbol: RBPJL
  Gene Name: recombination signal binding protein for immunoglobulin kappa J region-like
  ENST ID: ENST00000372741
  CDS Start-End: 73-1488
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 174610 - DNA, 1623 bp, Homo sapiens
  Payload ID: 14286
  Gene Symbol: RBPJL
  Gene Name: recombination signal binding protein for immunoglobulin kappa J region-like
  Uniprot ID: Q9UBG7
  ENST ID: ENST00000372743
  CDS Start-End: 73-1623
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 174611 - DNA, 702 bp, Homo sapiens
  Payload ID: 14286
  Gene Symbol: RBPJL
  Gene Name: recombination signal binding protein for immunoglobulin kappa J region-like
  ENST ID: ENST00000464504
  CDS Start-End: 1-554
ctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 174612 - DNA, 2819 bp, Homo sapiens
  Payload ID: 14287
  Gene Symbol: RCVRN
  Gene Name: recoverin
  Uniprot ID: P35243
  ENST ID: ENST00000226193
  CDS Start-End: 442-1044
attgcattctagggcttgatatgagatgccagccccgccccgagatgctcagagttagtgaggaagagaaacagggaacatggctgctgttagagggctggggctgggggtgccggaggccccagctctgagggttccaacctcctgtcctgttctagtatcgtcccgggaggccgagatgaattgcctgcctgccctgggctctttattttaatctcactagggttctgggagcacccccccccaccgctcccgccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggctattttcaaaatgatcactcccgaggacgtgaagctccttccagacgatgaaaacacgccggaaaagcgagccgagaagatctggaagtactttggaaagaatgatgatgataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctgggcacgtggctgctggtcatccttcaactggaaaaggaaatgatttctatcagtcacacctcaaagacaaggctgtgttgcgatggcagccctaggctgggctgctttggtgcggaatgagtctaatgcggtcctgctgtcatggagctcatggtccagaggggacaatgaacctggaaggagccatgaccagtggcccaggttaccatggaaacgtgcagagcaccaggggaggacacagtggaaggggctgacttgtcaggggggatcagggaccacatccctgacgaagggagatttaaattcagaaccactgcacacgaggcgggggacggggtcggggtggggaagtctcaaacagaaggcggccaacacagagccgctgaggcatgaatgaccatctcgagttccaggagaaggtcggggtggctggagggtagaaggaggagggagagcaaagtgtgagctgaatctaaaaggtaggcgggggctggaccacgcaaagccctccctgcagcctgtggtaagcacttgggggctcaccatggggacagcggtgccactgtggagttggaagtaggaggggtttatgtttgtaagagaagtccccagcaggctaaaataagtcagagaggagcaactgggggctccctggagtcagggagcccgatgaataagcttttgcagccactcagatggcctgggccaggggaaaggcaatgggatggagaggaccagatccagtgaggacacatttaggaggtagcatccacctggctggctgagggggcaggaggagagagggcaggaatggcagccaggcctgtagcttgggcagtgggtgaatagcaatgccatctatggagatgagaaatacagagagtctttggggtttcagggaacaatgatgaattcagcttcaatatagtatgaggtgaaggcagagccatagatggccctaaagccccttgttttagagacaaggaaaaggagtcccaatgacaggaagcagcttgcccaagggcagccagctgatgagcagaggtcaggcaagggctacccaccggcccccaactgcctcctcaaagctccagggcctgggatacccaggaactccatcagtgcattctccaagatccctggatttgttgctttgaaggcccatttattctccagcctcaagttccaagatgaggtcagaaaaatgcatggataccctggattcttgactgacctgtctgcaacctcttgaggctgaggagtctctagttgctggtattgtggtgatgcctccagaccccactttagccacagagatgacacaatcaccactgccaaagagcactcctctgtgtggagagcaaacgtgagaataaacacttatgaaccgtg

SEQ ID NO: 174613 - DNA, 1054 bp, Homo sapiens
  Payload ID: 14288
  Gene Symbol: RECQL
  Gene Name: RecQ helicase-like
  ENST ID: ENST00000314748
  CDS Start-End: 456-1054
atctgtgattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtt

SEQ ID NO: 174614 - DNA, 932 bp, Homo sapiens
  Payload ID: 14288
  Gene Symbol: RECQL
  Gene Name: RecQ helicase-like
  ENST ID: ENST00000396093
  CDS Start-End: 299-932
atctgtgattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaagga

SEQ ID NO: 174615 - DNA, 2572 bp, Homo sapiens
  Payload ID: 14288
  Gene Symbol: RECQL
  Gene Name: RecQ helicase-like
  Uniprot ID: P46063
  ENST ID: ENST00000421138
  CDS Start-End: 231-2180
gagatccgagagtcggagatcggagagtcggacacaggacagtcggacaccggacagtcaaacaccggagagttagaccgggcttctcggtggggagaggctctgggataactactgttacagctttgaagggtcaagggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgt

SEQ ID NO: 174616 - DNA, 3702 bp, Homo sapiens
  Payload ID: 14288
  Gene Symbol: RECQL
  Gene Name: RecQ helicase-like
  Uniprot ID: P46063
  ENST ID: ENST00000444129
  CDS Start-End: 470-2419
gtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactt

SEQ ID NO: 174617 - DNA, 565 bp, Homo sapiens
  Payload ID: 14288
  Gene Symbol: RECQL
  Gene Name: RecQ helicase-like
  ENST ID: ENST00000536240
  CDS Start-End: 247-565
gattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaa

SEQ ID NO: 174618 - DNA, 579 bp, Homo sapiens
  Payload ID: 14288
  Gene Symbol: RECQL
  Gene Name: RecQ helicase-like
  ENST ID: ENST00000539672
  CDS Start-End: 362-579
gtagcggaaagatctgctcgaggcctgggtgctttggtgtcggagatccgagagtcggagatcggagagtcggacacaggacagtcggacaccggacagtcaaacaccggagaggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattt

SEQ ID NO: 174619 - DNA, 600 bp, Homo sapiens
  Payload ID: 14288
  Gene Symbol: RECQL
  Gene Name: RecQ helicase-like
  ENST ID: ENST00000542432
  CDS Start-End: 207-600
gagtagcggaaagatctgctcgaggcctgggtgctttggtgtcggagatccgagagtcggagatcggagagtcggacacaggacagtcggacaccggacagtcaaacaccggagagaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatg

SEQ ID NO: 174620 - DNA, 578 bp, Homo sapiens
  Payload ID: 14288
  Gene Symbol: RECQL
  Gene Name: RecQ helicase-like
  ENST ID: ENST00000536964
  CDS Start-End: 289-578
gaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaaggaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagct

SEQ ID NO: 174621 - DNA, 725 bp, Homo sapiens
  Payload ID: 14289
  Gene Symbol: RECQL4
  Gene Name: RecQ helicase-like 4
  ENST ID: ENST00000534538
  CDS Start-End: 1-47
tggaggcggcgccggaggagacccgcggggcccaggccccaccctgaccccgcctcccgctcgcccacgcagcgctctaccgggaataccgcactctgaagcgtaccacgggccaggccggcggcgggctccgcagctccgagtcgctccccgcggcggccgaagaggcgccagagccccgctgctgggggccccatctgaatcgggctgcgaccaagagtccacagtctacgccagggcggagccgccagggctcggtgccggactacgggcagcggctcaaggccaatctgaaaggcaccctgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctg

SEQ ID NO: 174622 - DNA, 781 bp, Homo sapiens
  Payload ID: 14289
  Gene Symbol: RECQL4
  Gene Name: RecQ helicase-like 4
  ENST ID: ENST00000301323
  CDS Start-End: 1-112
ggcgaccacctatacccattgccgtctgaactgccctgggggccctgcccagctccaggccctggcccacaggtgtgcggcgtgggacaggggtgcttgtggagttcagtgagctggccttccaccttcgcagcccgggggacttgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttg

SEQ ID NO: 174623 - DNA, 1055 bp, Homo sapiens
  Payload ID: 14289
  Gene Symbol: RECQL4
  Gene Name: RecQ helicase-like 4
  ENST ID: ENST00000532846
  CDS Start-End: 1-1055
gctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggag

SEQ ID NO: 174624 - DNA, 686 bp, Homo sapiens
  Payload ID: 14289
  Gene Symbol: RECQL4
  Gene Name: RecQ helicase-like 4
  ENST ID: ENST00000524998
  CDS Start-End: 1-686
gggaataccgcactctgaagcgtaccacgggccaggccggcggcgggctccgcagctccgagtcgctccccgcggcggccgaagaggcgccagagccccgctgctgggggccccatctgaatcgggctgcgaccaagagtccacagtctacgccagggcggagccgccagggctcggtgccggactacgggcagcggctcaaggccaatctgaaaggcaccctgcagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggag

SEQ ID NO: 174625 - DNA, 1165 bp, Homo sapiens
  Payload ID: 14289
  Gene Symbol: RECQL4
  Gene Name: RecQ helicase-like 4
  ENST ID: ENST00000534626
  CDS Start-End: 1-1165
gccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcggggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgg

SEQ ID NO: 174626 - DNA, 988 bp, Homo sapiens
  Payload ID: 14289
  Gene Symbol: RECQL4
  Gene Name: RecQ helicase-like 4
  ENST ID: ENST00000531875
  CDS Start-End: 1-882
gccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacttgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagagtgagtgcactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggct

SEQ ID NO: 174627 - DNA, 3809 bp, Homo sapiens
  Payload ID: 14289
  Gene Symbol: RECQL4
  Gene Name: RecQ helicase-like 4
  ENST ID: ENST00000617875
  CDS Start-End: 43-3669
ctggacgatcgcaagcgcggaggccgggcgggcgcgcgcgccatggagcggctgcgggacgtgcgggagcggctgcaggcgtgggagcgcgcgttccgacggcagcgcgggcggcgaccgagccaggacgacgtggaggcggcgccggaggagacccgcgcgctctaccgggaataccgcactctgaagcgtaccacgggccaggccggcggcgggctccgcagctccgagtcgctccccgcggcggccgaagaggcgccagagccccgctgctgggggccccatctgaatcgggctgcgaccaagagtccacagtctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacttgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgttt

SEQ ID NO: 174628 - DNA, 3896 bp, Homo sapiens
  Payload ID: 14289
  Gene Symbol: RECQL4
  Gene Name: RecQ helicase-like 4
  ENST ID: ENST00000621189
  CDS Start-End: 1198-3753
cggctgcgcgggagattcgctggacgatcgcaagcgcggaggccgggcgggcgcgcgcgccatggagcggctgcgggacgtgcgggagcggctgcaggcgtgggagcgcgcgttccgacggcagcgcgggcggcgaccgagccaggtgcgggctgcccaggggccgaggggctgagggcgcggcccgcggctgacgcgttccctttacaggacgacgtggaggcggcgccggaggagacccgcgcgctctaccgggaataccgcactctgaagcgtaccacgggccaggccggcggcgggctccgcagctccgagtcgctccccgcggcggccgaagaggcgccagagccccgctgctgggggccccatctgaatcgggctgcgaccaagagtccacagtctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacttgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctgactgcactgcattgggggatgtcgggtagagctggggttgtcagaggctagggcagtgactgaggacctgggcaaaacctgccacagggtgtgggaacgaggaggctccaaaatgcagaataaaaaatgctcactttgttttta

SEQ ID NO: 174629 - DNA, 3704 bp, Homo sapiens
  Payload ID: 14290
  Gene Symbol: RECQL5
  Gene Name: RecQ helicase-like 5
  Uniprot ID: O94762
  ENST ID: ENST00000317905
  CDS Start-End: 161-3136
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacaca

SEQ ID NO: 174630 - DNA, 1749 bp, Homo sapiens
  Payload ID: 14290
  Gene Symbol: RECQL5
  Gene Name: RecQ helicase-like 5
  Uniprot ID: O94762
  ENST ID: ENST00000340830
  CDS Start-End: 161-1468
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactc

SEQ ID NO: 174631 - DNA, 3576 bp, Homo sapiens
  Payload ID: 14290
  Gene Symbol: RECQL5
  Gene Name: RecQ helicase-like 5
  Uniprot ID: O94762
  ENST ID: ENST00000423245
  CDS Start-End: 114-3008
ctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacaca

SEQ ID NO: 174632 - DNA, 3710 bp, Homo sapiens
  Payload ID: 14290
  Gene Symbol: RECQL5
  Gene Name: RecQ helicase-like 5
  Uniprot ID: O94762
  ENST ID: ENST00000420326
  CDS Start-End: 161-1393
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggctgttgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattgaattgggccctgttgtttcctgggatcttggggctgggggtgcccaacagcctggcatcttcttgtttctctgtgtgtttactcattcattcatttattcagctgataaatattgactgatgccagctctgtgccaggcacattggacatgggggatacactagtgggcagaaatagccccgtcccagagccggccatggtggctcatacctgttataccagcactttgggaggctgaagtgggaggatcgcttgagcctgggagttcaagaccagcctgggcaacatggcaagaccctgtctctactaaaaatac

SEQ ID NO: 174633 - DNA, 656 bp, Homo sapiens
  Payload ID: 14290
  Gene Symbol: RECQL5
  Gene Name: RecQ helicase-like 5
  ENST ID: ENST00000582464
  CDS Start-End: 1-356
gttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccga

SEQ ID NO: 174634 - DNA, 1922 bp, Homo sapiens
  Payload ID: 14290
  Gene Symbol: RECQL5
  Gene Name: RecQ helicase-like 5
  Uniprot ID: O94762
  ENST ID: ENST00000584999
  CDS Start-End: 337-1644
gtgggttctgcctaaagctgaattcccagcgctttggcttctctgagttggggttgtgtataggggtcttcgaacagttccggaaccagccagcagcctttaattcttgggcggaccacggccggttctgatatcttagggtgaagagagggaggtgtcggccagccaagagagaaaattgcggatcttgggctcaggaagacgggagaaggggttcggggtcccggggtggaagaacggtcgtcgtggttgcgcttatagaagtaggagcagagggttctcgtggcaaccttttactacctttgccttaacctttggccactgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaa

SEQ ID NO: 174635 - DNA, 709 bp, Homo sapiens
  Payload ID: 14290
  Gene Symbol: RECQL5
  Gene Name: RecQ helicase-like 5
  ENST ID: ENST00000582548
  CDS Start-End: 1-709
aaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaaggcctcctgggatgagggagccaccaggacccagtgctgtgatgcctgctcttccctctaccagcacctgcccgcccagagaccagggcacccctgaagtccagcccacccctgcaaaggacacatggaagggcaagcggcctcgatcccagcaggagaacccagagagccagcctcagaagaggccacgcccctcagcca

SEQ ID NO: 174636 - DNA, 816 bp, Homo sapiens
  Payload ID: 14290
  Gene Symbol: RECQL5
  Gene Name: RecQ helicase-like 5
  ENST ID: ENST00000580078
  CDS Start-End: 1-596
taagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaaggggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagc

SEQ ID NO: 174637 - DNA, 793 bp, Homo sapiens
  Payload ID: 14290
  Gene Symbol: RECQL5
  Gene Name: RecQ helicase-like 5
  ENST ID: ENST00000581825
  CDS Start-End: 1-619
tctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgaca

SEQ ID NO: 174638 - DNA, 1972 bp, Homo sapiens
  Payload ID: 14290
  Gene Symbol: RECQL5
  Gene Name: RecQ helicase-like 5
  ENST ID: ENST00000578201
  CDS Start-End: 532-1972
ccagccagcagcctttaattcttgggcggaccacggccggttctgatatcttagggtgaagagagggaggtgtcggccagccaagagagaaaattgcggatcttgggctcaggaagacgggagaaggggttcggggtcccggggtggaagaacggtcgtcgtggttgcgcttatagaagtaggagcaggtggtggatcttaggaaaacggttccccgttctccaagctgttctgaagacatttatgtttcttctcttgatctgatttctagctctgtgctataccgtggcctggaatagttcaatgttttcattttcattgagcgtaaaagtggagatgttaattactgaggaatgtattgcttgaggcagttcaccttcagctttattacttaaaaataatacattatttaagtgtaatatagcaaattgttacagaaaaataatctgtatttttaatgcaaaacagagggttctcgtggcaaccttttactacctttgccttaacctttggccactgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggact

SEQ ID NO: 174639 - DNA, 948 bp, Homo sapiens
  Payload ID: 14290
  Gene Symbol: RECQL5
  Gene Name: RecQ helicase-like 5
  ENST ID: ENST00000580707
  CDS Start-End: 377-948
ttcgggggctgccggccaaggcggcggctggtggtggtttctggcttcgctgttccattcccttgtcttgaggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctgga

SEQ ID NO: 174640 - DNA, 3420 bp, Homo sapiens
  Payload ID: 14291
  Gene Symbol: RMI1
  Gene Name: RecQ mediated genome instability 1
  Uniprot ID: Q9H9A7
  ENST ID: ENST00000325875
  CDS Start-End: 333-2210
aaaaaggaactgggagcgcgccgcggcggttcctgtccttacagttgcgctgcccagggaccgatgttgcgcgaggaaaatgcgggacgcccaggtcggtgctcggcccagacttatgcccgtgttttcacagcccacactcgtgcccgaagccccttaccccgccccgggctgtggtctgtgggctgtgggacgagctgcggcgcgggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatgactatttcatttaatccttccttgtctaaagcaatggtactggcattacaagatgttaatatggaacaccttgagaatctaaagaagcggttaaataaataattaaactaaaatagtattaggaacaattaaaaacaacaaggaaatatttagaatttgttcacaattttacttatgatactttgtgtaaaaaggaaaaatgaaatttcatagcttatttcagtttaattttaaagtgtttaatcatgtttgttatatgtggagcttttgaaaataagttaatctttttttttttttttttaatgtcagggtattgctctgttgcccaggctagagtgcagtggcatgatcataggttattgcatcaacctcttgagctcaagcgatcctcctgccttagcctcttgagttgctgggactataggcatgtaccaccatgcccagctaatttataattactattattgttttgtagggacagagttttgctatgttgcccagattggtctcaaactcctggcctctcactcctgccgtcatggcctccaaagtttactttttttaaaagtaactgttagatggaggaatatggtgacccactattgttgagaaatttgttttccacttgtcacgtcacataagatgattgctaaaatattgtactggtgttcggtggtgagtcatatttttgaaagttaataattataaataggtaatttccttctaatatgttggtactgtctatggccataccaccctgaacatgcctgagcttgtcataatatgttgagtacccaaaagatttgtttatattgttaatcttagggaaaaaaaattaaaatccagtagatcagaacatcaggctttcagatacaaattgatttactggtttttattttgctgattataatatttggtatatttaaggtaatctagttaactagatgctatttcatagattatattgaatgatttaaaactttattttcaaggatagtttattttaaatggcatattgaaaacatcattattaagatccagtaggtaggacatttattggattaaaatgaagcatttatctatgtctttaggtgtcattgttccctttctgaattagctgtacatataagccttcctttggttttaagtactgatttttttttaaaaaaaagagggactgtttaccattcttccactgtgctgttataaagttgtatttgaaaggtaatgttgtttttattaatcttttgtcttaaaataatttaaagtgctttgaattttaaaacattaaacaaatccttaaataacaaaa

SEQ ID NO: 174641 - DNA, 1553 bp, Homo sapiens
  Payload ID: 14291
  Gene Symbol: RMI1
  Gene Name: RecQ mediated genome instability 1
  ENST ID: ENST00000445877
  CDS Start-End: 307-1553
ggggaaggggcgttttccagccccgaaggagtcctttggggttggaggaggggcgcgagcgcgcggcaaatcgggcgggaagaggtaaaaaaggaactgggagcgcgccgcggcggttcctgtccttacagttgcgctgcccagggaccgatgttgcgcgaggaaaatgcgggacgcccagggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaa

SEQ ID NO: 174642 - DNA, 1923 bp, Homo sapiens
  Payload ID: 14291
  Gene Symbol: RMI1
  Gene Name: RecQ mediated genome instability 1
  ENST ID: ENST00000615118
  CDS Start-End: 149-1561
cgaggaaaatgcgggacgcccagggccatttctgagcagtggaggtttcaagtaatccactaacaaccagttccaaattctgtcatcaaatcctgtgctgctgttcctcgtggtaatagatgcatattatttcttttatttaaaagaaatgaatgtgactagtattgcattaagagctgaaacttggcttttagctgcatggcatgttaaagtacctccgatgtggctggaagcttgtattaactggattcaagaagaaaataataatgttaacttgagtcaggcccaaatgaataaacaagtgtttgagcagtggctccttactgatctgagggatttggagcatcctcttttacccgatggcattttagaaattccaaaaggagaattaaatggattttatgctctgcagattaattccttggttgatgtaagtcagcctgcatactcccagatacagaagttgagaggaaagaatacaacaaatgatctagttacagctgaagcacaagtaaccccaaaaccttgggaagcaaagccttcacgaatgttgatgctgcagctaactgatggaatcgtacaaatacagggaatggaatatcagcctattccaattcttcatagtgatcttcctccaggtacaaaaattttgatttatggaaatatatctttccgtcttggtgttctcttattgaaaccagaaaacgtgaaagtgttaggaggtgaagtagatgctcttttagaagaatatgcccaagaaaaagtacttgcaagattaataggggaacctgatcttgtagtttcagtcataccaaacaattctaacgaaaacattcccagagttacagatgttctagatcctgcattaggtccttctgatgaagaactcttggcaagtcttgatgaaaatgatgagcttacagcaaataatgacacttcctcagaacgatgtttcaccacaggtagttcctcaaataccattcccacaagacagtcaagttttgagccagaatttgttatttctccaagaccaaaagaggaaccatcaaacctatctatacatgtaatggatggagaattagatgacttttcactggaggaggccttgcttttagaagaaactgtccagaaagaacagatggaaactaaggaattgcaaccattgacttttaacagaaatgccgatcgaagtatagagagattttcacataatcctaatactacgaataacttttctttgacttgcaaaaatggaaacaataattggagtgaaaaaaatgtatctgaacaaatgactaatgaagacaaatcatttggttgtccatctgttagagaccaaaacaggagtattttttcagttcattgtaatgtacccttagcccatgattttacaaataaagaaaagaacttagagacagataataaaataaaacaaaccagcagttcagatagccattccttaaataataaaatattaatagagaggtggtcaactatgtacagaaaaggaattcacaaatttctaatgaaaatgattgtaatttacagagttgttctttaagatcatcagagaatagcattaatctttctattgccatggatttgtattctccaccctttgtctatttgtctgttctaatggccagcaaaccaaaggaagttacaacagtgaaagtgaaagcatttattgtaaccttaactggaaatctctcaagttctggtggtatttggagtataactgcaaaggtgtctgatggtactgcatatctagatgtagactttgtggatgaaatacttactagcttgatagggttctcagtaccagaaatgaaacagtcaaaaaaggatcctcttcaataccaaaagttcctggaagggttgcagaaatgtcaaagagatctaatagatttgtgctgtctaatg

SEQ ID NO: 174643 - DNA, 1457 bp, Homo sapiens
  Payload ID: 14292
  Gene Symbol: RMI2
  Gene Name: RecQ mediated genome instability 2
  Uniprot ID: Q96E14
  ENST ID: ENST00000312499
  CDS Start-End: 42-485
cgggaaagcggaggcggggcggaagggtgcggcgaggcggaatggcggcggctgcggactcgttctcaggcggccccgcgggggtgcggcttccgaggtcgccgccactcaaggtgctggcggagcagctgcggcgcgacgcggagggcggcccgggcgcgtggcggctgtcacgggcggcggcgggccgcgggccgctggacctggcggccgtgtggatgcagggcagggtagtgatggcggaccgcggcgaggctcggctgagggacccgagcggggacttctcggtccgcggcctggagcgggtgccgcgcgggcggccctgtctagtcccaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacctctaataaatttttaataggctg

SEQ ID NO: 174644 - DNA, 818 bp, Homo sapiens
  Payload ID: 14292
  Gene Symbol: RMI2
  Gene Name: RecQ mediated genome instability 2
  ENST ID: ENST00000576027
  CDS Start-End: 23-106
cggaagggtgcggcgaggcggaatggcggcggctgcggactcgttctcaggcggccccgcgggggtgcggcttccgaggtcgccgccactcaaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcgga

SEQ ID NO: 174645 - DNA, 1865 bp, Homo sapiens
  Payload ID: 14292
  Gene Symbol: RMI2
  Gene Name: RecQ mediated genome instability 2
  Uniprot ID: Q96E14
  ENST ID: ENST00000572173
  CDS Start-End: 646-900
gtcagctggacaaaagccgacccgacttcatttgtctgcctcgaccccgaccccggctggtagacagcactcctgatgcacgggacgagggagcggcacgagcaaaggccctgaaacaggagggagcgcggggtacctgagtgagattcatcgtagatgcctggatgaagagaggggccttgcgcttctatttgccttgttacatagtgtttcttggaaaggctgtccttccctactccaagcccctcccctcactccccacccaggatctgggcactggaggcgccagacatcttatgccctgtccaaggctagcagggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgcaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacctctaataaatttttaa

SEQ ID NO: 174646 - DNA, 11565 bp, Homo sapiens
  Payload ID: 14293
  Gene Symbol: RELN
  Gene Name: reelin
  Uniprot ID: P78509
  ENST ID: ENST00000343529
  CDS Start-End: 161-10537
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 174647 - DNA, 11571 bp, Homo sapiens
  Payload ID: 14293
  Gene Symbol: RELN
  Gene Name: reelin
  ENST ID: ENST00000424685
  CDS Start-End: 161-10543
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctatttagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 174648 - DNA, 11571 bp, Homo sapiens
  Payload ID: 14293
  Gene Symbol: RELN
  Gene Name: reelin
  Uniprot ID: P78509
  ENST ID: ENST00000428762
  CDS Start-End: 161-10543
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 174649 - DNA, 891 bp, Homo sapiens
  Payload ID: 14293
  Gene Symbol: RELN
  Gene Name: reelin
  ENST ID: ENST00000429186
  CDS Start-End: 1-206
tactgcgctggtggcaaccacgccacaatggaacaggtcatgatcaatgggctttggaccatgtggaggtcgtcctagatgaaaaatcctatattgcgtctaaacctgatcagacttttatgactaatcacagtgctgcatgcattgaaaggcattttttaacttgtgttatatttcattatttgctgtcattggttttccactagagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaaga

SEQ ID NO: 174650 - DNA, 808 bp, Homo sapiens
  Payload ID: 14294
  Gene Symbol: REG1A
  Gene Name: regenerating islet-derived 1 alpha
  Uniprot ID: P05451
  ENST ID: ENST00000233735
  CDS Start-End: 104-604
gatataaagctcctacagctacctggcctgagaagccaactcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcaactggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccactattgtgctgtc

SEQ ID NO: 174651 - DNA, 767 bp, Homo sapiens
  Payload ID: 14295
  Gene Symbol: REG1B
  Gene Name: regenerating islet-derived 1 beta
  Uniprot ID: P48304
  ENST ID: ENST00000305089
  CDS Start-End: 82-582
aagccacctcaagtggacaaggcacttaccaacagagattgctgatttgctccttaagcaagagattcactgccgctaagcatggctcagaccaactcgttcttcatgctgatctcctccctgatgttcctgtctctgagccaaggccaggagtcccagacagagctgcctaatccccgaatcagctgcccagaaggcaccaatgcctatcgctcctactgctactactttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttt

SEQ ID NO: 174652 - DNA, 626 bp, Homo sapiens
  Payload ID: 14295
  Gene Symbol: REG1B
  Gene Name: regenerating islet-derived 1 beta
  ENST ID: ENST00000454188
  CDS Start-End: 1-450
tttaatgaagaccctgagacctgggttgatgcagatctctattgccagaacatgaattcaggcaacctggtgtctgtgctcacccaggcggagggtgccttcgtggcctcactgattaaggagagtagcactgatgacagcaatgtctggattggcctccatgacccaaaaaagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttattttta

SEQ ID NO: 174653 - DNA, 718 bp, Homo sapiens
  Payload ID: 14296
  Gene Symbol: REG3A
  Gene Name: regenerating islet-derived 3 alpha
  Uniprot ID: Q06141
  ENST ID: ENST00000305165
  CDS Start-End: 57-584
cataccatatcccaccagagagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttct

SEQ ID NO: 174654 - DNA, 1095 bp, Homo sapiens
  Payload ID: 14296
  Gene Symbol: REG3A
  Gene Name: regenerating islet-derived 3 alpha
  Uniprot ID: Q06141
  ENST ID: ENST00000393878
  CDS Start-End: 349-876
aaaccataccatatcccaccagagaggtaagtgggagctgagagaagatgagacccagggaggagctactgcacatgacacaggagaatacatgggagggtcccttcctcagggagcacaggaactctgagactcagcaagggtgtcctgggagggctcggggatgggagagtacacagattcacaactcattcagaactgtagaagatgatggatgtgaccaagatcactttagtcctaggggactagagaaggaaaatgacatgaggcagtggggtatctgtgtgttctcccactgaccacgctttctttagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgc

SEQ ID NO: 174655 - DNA, 788 bp, Homo sapiens
  Payload ID: 14296
  Gene Symbol: REG3A
  Gene Name: regenerating islet-derived 3 alpha
  Uniprot ID: Q06141
  ENST ID: ENST00000409839
  CDS Start-End: 38-565
aaaccataccatatcccaccagagagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgcactt

SEQ ID NO: 174656 - DNA, 938 bp, Homo sapiens
  Payload ID: 14297
  Gene Symbol: REG3G
  Gene Name: regenerating islet-derived 3 gamma
  Uniprot ID: Q6UW15
  ENST ID: ENST00000272324
  CDS Start-End: 185-712
catccctgagatctttttataaaaaacccagtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctattcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatac

SEQ ID NO: 174657 - DNA, 856 bp, Homo sapiens
  Payload ID: 14297
  Gene Symbol: REG3G
  Gene Name: regenerating islet-derived 3 gamma
  Uniprot ID: Q6UW15
  ENST ID: ENST00000393897
  CDS Start-End: 100-627
attcactccagtgaccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctattcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatacgta

SEQ ID NO: 174658 - DNA, 575 bp, Homo sapiens
  Payload ID: 14297
  Gene Symbol: REG3G
  Gene Name: regenerating islet-derived 3 gamma
  Uniprot ID: Q6UW15
  ENST ID: ENST00000409471
  CDS Start-End: 159-548
cccagtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagc

SEQ ID NO: 174659 - DNA, 1357 bp, Homo sapiens
  Payload ID: 14298
  Gene Symbol: REG4
  Gene Name: regenerating islet-derived family, member 4
  Uniprot ID: Q9BYZ8
  ENST ID: ENST00000256585
  CDS Start-End: 347-823
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccatgggaaggtttaccagtagaatccttgctaggttgatgtgggccatacattcctttaataaaccattgtgtacataagag

SEQ ID NO: 174660 - DNA, 1517 bp, Homo sapiens
  Payload ID: 14298
  Gene Symbol: REG4
  Gene Name: regenerating islet-derived family, member 4
  Uniprot ID: Q9BYZ8
  ENST ID: ENST00000354219
  CDS Start-End: 441-917
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagaatgcccatatccgtcttacctgtgaggaagcttgccttgggcgccctctgctggccctcctgaagctaacaggggcgagtgctcggtggtttacaaattgcctccatgcagactatgaaactgttcagcctgctatagttagatctctggcactggcccaggaggtcttgcagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccatgggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 174661 - DNA, 2327 bp, Homo sapiens
  Payload ID: 14298
  Gene Symbol: REG4
  Gene Name: regenerating islet-derived family, member 4
  Uniprot ID: Q9BYZ8
  ENST ID: ENST00000369401
  CDS Start-End: 267-671
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgaggtaagaaacttgctgcctgcttggcctggcctttctagagcaaaggaccagccagagccccagatctcatttgattcaggatcaagtgtccttcctgggcactatgaagagaagcccctttggctggtgaaatggagagaagagggttgtgtgttcaactcattcaattctgtaagcattgctgaagcaggtgctgtatgccagaccctagatgggctacaagcacatacggatacataggaaagagcccctaccctcagcaagctcactgtcagtaaaggagacagaaatacatcaatcaaaggaggaagagaagatgaggaattcacagaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcctatgcggtcttacaatccctgtataaaactagacaatgaaaaacagaaaacaaaacaaacaaacaaaaaaacaagaacgaagcacctaccacatgccagctactgaggctatgaaggtattctcccgccttagaaagcccaggattaatgcaggattgcgacatttaaacagaacatttccatacagcatgagtataaatgactttcccaagtttacactgagagtaactgacacagcaaccccagcaaagtctgagctgagtcctgaataattgtataaaaaggggagagaaacagagtgaagaaagggtttcccagactctgtcccaggaaagaaaatgagctcgtggagaggaatagactttctctatgaaaacagagggaacaaagaggaagatgtctgggaaccgaggagtaatagagacctgagtttacatcactactctgccactccctaggtacctccctttacctgtttccctactggaaagtgggataatactttttacctcatggacttgtcaggaggattcattaaaacgactcgcataaagcctatgccacatggtagatgccaattcagggtctcaagaaagaacagcccacaggattgacactgaaccttaacaaagttaacaggaccaaggtgcagagagggtgctaggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctagttacagccccagcagtaccagttgtgtggactgggagggaggctatcacgtacatacttcaagcctccaaacctgtttccccttctgacacaggatcttctgtggctggtatagagtgggcactcaataaatgctgtctggtcgtctggctggcatgcctcatgggcctgagaattgaatagaattacagtgatagaagcatgctggtattgtaagtggtttgtaagtgtgaggactaaattattattaaatagtaatcacatctaatcttggataaattagtaaaagcaagaatgggagcagtaaaaacctaagcaacccgaactaaaattttattgaattaattcaatttcttgtcatgtaacacaaccccagaagagaataaaataaagtttatatacatacaccca

SEQ ID NO: 174662 - DNA, 612 bp, Homo sapiens
  Payload ID: 14298
  Gene Symbol: REG4
  Gene Name: regenerating islet-derived family, member 4
  ENST ID: ENST00000530654
  CDS Start-End: 37-348
tccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgc

SEQ ID NO: 174663 - DNA, 1611 bp, Homo sapiens
  Payload ID: 14299
  Gene Symbol: RGN
  Gene Name: regucalcin
  Uniprot ID: Q15493
  ENST ID: ENST00000352078
  CDS Start-End: 346-1245
ccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacc

SEQ ID NO: 174664 - DNA, 1356 bp, Homo sapiens
  Payload ID: 14299
  Gene Symbol: RGN
  Gene Name: regucalcin
  Uniprot ID: Q15493
  ENST ID: ENST00000336169
  CDS Start-End: 94-993
acaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatg

SEQ ID NO: 174665 - DNA, 2257 bp, Homo sapiens
  Payload ID: 14299
  Gene Symbol: RGN
  Gene Name: regucalcin
  Uniprot ID: Q15493
  ENST ID: ENST00000397180
  CDS Start-End: 991-1890
gagaaatctccatcctggcgagtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacct

SEQ ID NO: 174666 - DNA, 2041 bp, Homo sapiens
  Payload ID: 14299
  Gene Symbol: RGN
  Gene Name: regucalcin
  Uniprot ID: Q15493
  ENST ID: ENST00000457380
  CDS Start-End: 991-1674
gagaaatctccatcctggcgagtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctgccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacct

SEQ ID NO: 174667 - DNA, 795 bp, Homo sapiens
  Payload ID: 14300
  Gene Symbol: RESP18
  Gene Name: regulated endocrine-specific protein 18
  Uniprot ID: Q5W5W9
  ENST ID: ENST00000333527
  CDS Start-End: 1-687
atggcagtggatgtggaattcggagtcgcgggctggtgggaagctgcagccccgctcagcccctcggccgtggccgctaccttcactgagacttggccggggagtgagcgcgccgagcctgggaggatacagcacccactgtggcctgggagctccgaggggctccagctgcttgtctgcttcctgctgctgaacagctgcccggggggctgcagcgacactagtgcccacgatggtcaggaccaagtaggagtggggcagctttggcccctccaaggatttgccaccccagtcttccagcatttacaggttgtgctccagcagattataccccaaggtctgttctggaaggatgacatcacccaggatgcaatgatccaaaagatggagcatgccagcagactgcatccccaagaaccatgcctgaaggatgggaaggcacttttccccactaaaaccactgagagccccctggccaaggtgaacagggatcagtgctttacctccgaagtggtttctaaggccctgaaacaagaggtggccaaccctgtcaagattacctataggtgttcatatggggggctggacatgatgcaggcgccgggaccctctaaggaagaaattatctataagatcatgcggcttctctgggccacttcctactgtgggccgcaaccctgtggctgattgagacctcatgtgaagcctccctgccccagcacccttcccattgcccttcagaggagcagttcttggatgacccagatttgaatcattaaagtagactctcatgca

SEQ ID NO: 174668 - DNA, 626 bp, Homo sapiens
  Payload ID: 14300
  Gene Symbol: RESP18
  Gene Name: regulated endocrine-specific protein 18
  ENST ID: ENST00000392083
  CDS Start-End: 247-522
atacagcacccactgtggcctgggagctccgaggggctccagctgcttgtctgcttcctgctgctgaacagctgcccggggggctgcagcgacactagtgcccacgatggtcaggaccaagtaggagtggggcagctttggcccctccaaggatttgccaccccagtcttccagcatttacaggttgtgctccagcagattataccccaaggtctgttctggaaggatgacatcacccaggatgcaatgatccaaaagatggagcatgccagcagactgcatccccaagaaccatgcctgaaggatgggaaggcacttttccccactaaaaccactgagcaagaggagaaacttcaactcctattccccagtgagactcacagccccctggccaaggtgaacagggatcagtgctttacctccgaagtggtttctaaggccctgaaacaagaggtggccaaccctgtcaagggcttctctgggccacttcctactgtgggccgcaaccctgtggctgattgagacctcatgtgaagcctccctgccccagcacccttcccattgcccttcagaggagcagttcttggatgacccagatttgaatcattaaagtagactctcatgca

SEQ ID NO: 174669 - DNA, 7055 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000264839
  CDS Start-End: 1-4626
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 174670 - DNA, 2223 bp, Homo sapiens
  Payload ID: 14301
  Gene Symbol: RIMS1
  Gene Name: regulating synaptic membrane exocytosis 1
  ENST ID: ENST00000370420
  CDS Start-End: 1-2223
cgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 174671 - DNA, 3542 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000401910
  CDS Start-End: 313-3351
agtaaatgctaccagtccccacaccaccaggcccaccgaagcttgtctacagtattttatccaagcagtcctttgggtaactgcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatc

SEQ ID NO: 174672 - DNA, 2500 bp, Homo sapiens
  Payload ID: 14301
  Gene Symbol: RIMS1
  Gene Name: regulating synaptic membrane exocytosis 1
  ENST ID: ENST00000453976
  CDS Start-End: 241-2500
gattcctcagttagggaaactgcagaggaaatgatctgttacacagggcttggcaggaccattgccagtgattgataatgggaccaaatcatttcaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatag

SEQ ID NO: 174673 - DNA, 1787 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000414192
  CDS Start-End: 191-850
agttcacaggcagctcagacagatattccagccagccaccgcacaagttatttaaaccaggtcaaagcttctttggcattcagttttccccagagaacaatttaatgctgatacttaattttttcaagatagacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaa

SEQ ID NO: 174674 - DNA, 2799 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000425662
  CDS Start-End: 341-2623
agaaaagcctgaagaagcacttttgcctgtgttcccaacaatcaattgtgtatactcttggtttatgctttctggtgccagttgtcattgagctgagtaagattcctcagttagggaaactgcagaggaaatgatctgttacacagggcttggcaggaccattgccagtgattgataatgggaccaaatcatttcaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacaga

SEQ ID NO: 174675 - DNA, 3097 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000523963
  CDS Start-End: 231-2684
gcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgtttt

SEQ ID NO: 174676 - DNA, 3065 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000517827
  CDS Start-End: 430-2910
gtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaa

SEQ ID NO: 174677 - DNA, 5079 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000521978
  CDS Start-End: 1-5079
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagctcaattctgcctgcacatactaagaccaaatcagtgactagacaggacatttcccttcatcatgaatgctttaactcaacagtattgagatttactgatgaaatactggttagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacaggcactccagaaagtctgaaagatctagcatccaaaaacagactaggaaaggcactgcctctgatgcagaaagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 174678 - DNA, 2285 bp, Homo sapiens
  Payload ID: 14301
  Gene Symbol: RIMS1
  Gene Name: regulating synaptic membrane exocytosis 1
  ENST ID: ENST00000522211
  CDS Start-End: 1-1832
cagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagaacaagaaaaatataactcttccacaaaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttg

SEQ ID NO: 174679 - DNA, 4428 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000517960
  CDS Start-End: 1-4428
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 174680 - DNA, 5047 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000491071
  CDS Start-End: 322-4767
ctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatggctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacac

SEQ ID NO: 174681 - DNA, 3489 bp, Homo sapiens
  Payload ID: 14301
  Gene Symbol: RIMS1
  Gene Name: regulating synaptic membrane exocytosis 1
  ENST ID: ENST00000517433
  CDS Start-End: 1-3115
ttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacaga

SEQ ID NO: 174682 - DNA, 4116 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000518273
  CDS Start-End: 1-4116
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 174683 - DNA, 4442 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000520567
  CDS Start-End: 1-4029
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgtttt

SEQ ID NO: 174684 - DNA, 3876 bp, Homo sapiens
  Payload ID: 14301
  Gene Symbol: RIMS1
  Gene Name: regulating synaptic membrane exocytosis 1
  Uniprot ID: Q86UR5
  ENST ID: ENST00000522291
  CDS Start-End: 1-3876
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 174685 - DNA, 3854 bp, Homo sapiens
  Payload ID: 14302
  Gene Symbol: RIMS2
  Gene Name: regulating synaptic membrane exocytosis 2
  Uniprot ID: Q9UQ26
  ENST ID: ENST00000262231
  CDS Start-End: 249-3815
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 174686 - DNA, 3780 bp, Homo sapiens
  Payload ID: 14302
  Gene Symbol: RIMS2
  Gene Name: regulating synaptic membrane exocytosis 2
  Uniprot ID: Q9UQ26
  ENST ID: ENST00000339750
  CDS Start-End: 318-1175
ctccagcagctccagcctccaggattctcagctccctcccgggcgagacctcggacgttcactgcgagcagccgctccgcccgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggagaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcaattactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaaggagagagaatgcaacagggtgatacaaagatacaccatgtttattctttaatcatagtctgtgttttggcagacattacaaatggaaatactttctagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttcttta

SEQ ID NO: 174687 - DNA, 4382 bp, Homo sapiens
  Payload ID: 14302
  Gene Symbol: RIMS2
  Gene Name: regulating synaptic membrane exocytosis 2
  ENST ID: ENST00000406091
  CDS Start-End: 371-1783
agaataacctttttcttaacaggcccatcactagaggattctatgactccatcctttgaatgagtgttgtttttgtgtaattttttagtaacttagttttgaaataaaacaattgtaaacaagtagagactttcaaatcatctgattaaggatggctcctatgattttgccagggctagaaggattaaatgaaagcactgcctggcacactgttgatgtatttttgtcaacatgatgcttcatgctcgacagatgtgcattggttgaacaaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggattccttctatttctgttacctctcccatgagtcctggaatgttgagggatgtcccacagttcttatcaggacaactttcaagccaaagccttagtagaagaacaacgccttttgttcctagggttcagataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcaggtctcatcctcgtactgggtctgtccagacaagcccatcaagtactccagtcgcaggacgaaggggccgacagcttccacagcttccaccaaagggaacgttggatagaaacaatggagtcaaggagatagaaccttatgaagaagaactggactctacaaggagaagatatgcaggtactatggatatagaggagagaaatcgccaaatgaaaattaacaaatacaaacaggtagccggatcagatcccagactggaacaagattaccattcgaagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcagaccaaagggaatagaagagggagggaaagaaggggataagcatgaagagatagttcatgagaaggaagaggtaaaggaagaaagaattaatgagaatgagaaagggaaagagattgccaaaacgtgtaataaggagaaaaacagagaatcaggagacgaggaaaaaacacaagatatacacgagcaagggaaagaaaaagaacagtggaataaagaggatttgcaaaggagattctcacaagatgataccagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacggaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 174688 - DNA, 3880 bp, Homo sapiens
  Payload ID: 14302
  Gene Symbol: RIMS2
  Gene Name: regulating synaptic membrane exocytosis 2
  ENST ID: ENST00000408894
  CDS Start-End: 122-3880
agagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaacaatggagtcaaggagatagaaccttatgaagaactggactctacaaggagaagatatgcaggtactatggatatagaggagagaaatcgccaaatgaaaattaacaaatacaaacaggtagccggatcagatcccagactggaacaagattaccattcgaagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacggaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagcc

SEQ ID NO: 174689 - DNA, 4384 bp, Homo sapiens
  Payload ID: 14302
  Gene Symbol: RIMS2
  Gene Name: regulating synaptic membrane exocytosis 2
  ENST ID: ENST00000436393
  CDS Start-End: 242-4345
agaataacctttttcttaacaggcccatcactagaggattctatgactccatcctttgaatgagtgttgtttttgtgtaattttttagtaacttagttttgaaataaaacaattgtaaacaagtagagactttcaaatcatctgattaaggatggctcctatgattttgccagggctagaaggattaaatgaaagcactgcctggcacactgttgatgtatttttgtcaacatgatgcttcatgctcgacagatgtgcattggttgaacaaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaagccaaagccttagtagaagaacaacgccttttgttcctagggttcagataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcaggtctcatcctcgtactgggtctgtccagacaagcccatcaagtactccagtcgcaggacgaaggggccgacagcttccacagcttccaccaaagggaacgttggatagaaacaatggagtcaaggagatagaaccttatgaagaagaactggactctacaaggagaagatatgcaggtactatggatatagaggagagaaatcgccaaatgaaaattaacaaatacaaacaggtagccggatcagatcccagactggaacaagattaccattcgaagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcagaccaaagggaatagaagagggagggaaagaaggggataagcatgaagagatagttcatgagaaggaagaggtaaaggaagaaagaattaatgagaatgagaaagggaaagagattgccaaaacgtgtaataaggagaaaaacagagaatcaggagacgaggaaaaaacacaagatatacacgagcaagggaaagaaaaagaacagtggaataaagaggatttgcaaaggagattctcacaagatgataccagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacggaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 174690 - DNA, 8002 bp, Homo sapiens
  Payload ID: 14302
  Gene Symbol: RIMS2
  Gene Name: regulating synaptic membrane exocytosis 2
  Uniprot ID: Q9UQ26
  ENST ID: ENST00000507740
  CDS Start-End: 237-3728
acagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcaattactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaaggagagagaatgcaacagggtgatacaaagatacaccatgtttattctttaatcatagtctgtgttttggcagacattacaaatggaaatactttctagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttctttacaggcgtctgcagtgctttctctgacttttctccccacacagccctgagcctgctgcagctcattccctgaactcatgtgtcatttaaagaatgaaatcaccgtctcctacttctcgataacataagtggactgctggtcttagcagcggccctcagtagagcatttctttaaaacgccaaaggatttctgctcacactatgaaaaggtgctgttttttaaaaggttgttattttggattgagtttctttctgattaaatgactcagcaactcacagattttttgagtgaaatttttaatttagtcatggccttcactgacagcatagtcacaaatactcaggcacaggctctgctagcccctgggtgaagatggcgaaggcataactggctttatgcagcatatgtgtttctgctaaagtgtcagttttgctttgtggggagtggagggtgtgttttcgggatggggagacgtggtaacctgacatgtaacaacctgtccggagactagcttctacgtgtggatatgaatgggtgagaggatttctccatatccttctggggcgattcctcaactgggagaaggaaaccctgcagagttctcatgggagtctgcttcaggtttgaaatttaagagctagtttggattcatgtttagtaatcgaactgaaatctaagtctagctgtctctctattcttggaaacaaccatttcctccatttccaaagactcaactcgagtccaattccccctatctgtcccatatatttttcctttatcccatatataccccctactctagtgaattgtttctttgttgttcattcctgttctttgttgttcatatacattcctgtatatgaacaacattttcctttatcccatatataccccctactctagtgaattgtttctttgttgttcattcctgtttctttgttgttcatatacattcctgttataaaaattcccttccctttcttatgtgccctctcctgaaaagcccttctacttttctcaataatgatccatgcgagtcccttcttgcaactcccagctcacgaatgagctctttcggcaactcctgactaaaccctaacaacatggctgccattgatgccaacaccttcactttcccagggaccccagatgccaaggctccataggcaacaataaaggatatgatggtcctgtagtgggtatgatagaattaggcaagagatcaccaaagctgtctgcctactactgatgtaaaccttgacattctgtgcacgtaaaaatcatgtgctcaatgtgtttgtctcaactccctcagctcgtgatgccctcagggttctgtgggcatttatgcactgaagaaacaggagttcacacatccacctctggactgtgaaatgtgtattgagaaatactttgcaagagagaatttttttaagtgaacaaacaacaagtctgtgccacacacatcttccatatgccctgactcaggtcacttaatctccaggatttcatttcctcacctggaaaatatggagtttgaggtagattctcatctatcattaaatcaacactttaactaaaacgtaagctccttcagggcagagaccgtatcttcagtatcaaaaacaatgtttgacacatagctgctcaataaacatctgtccaatgaa

SEQ ID NO: 174691 - DNA, 2285 bp, Homo sapiens
  Payload ID: 14302
  Gene Symbol: RIMS2
  Gene Name: regulating synaptic membrane exocytosis 2
  ENST ID: ENST00000515551
  CDS Start-End: 289-2285
acacttcagctgggaatgcccaaaaagcttactgctgtttagaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctc

SEQ ID NO: 174692 - DNA, 4228 bp, Homo sapiens
  Payload ID: 14302
  Gene Symbol: RIMS2
  Gene Name: regulating synaptic membrane exocytosis 2
  Uniprot ID: Q9UQ26
  ENST ID: ENST00000504942
  CDS Start-End: 140-4189
gctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaagccaaagccttagtagaagaacaacgccttttgttcctagggttcagataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 174693 - DNA, 1062 bp, Homo sapiens
  Payload ID: 14302
  Gene Symbol: RIMS2
  Gene Name: regulating synaptic membrane exocytosis 2
  ENST ID: ENST00000523362
  CDS Start-End: 289-1062
agctccctcccgggcgagacctcggacgttcactgcgagcagccgctccgcccgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaaccgctgcggacgctgcgccccagccgccaagacgccgcgtatcttgtaccgcgggaaaagcgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggagaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagta

SEQ ID NO: 174694 - DNA, 4143 bp, Homo sapiens
  Payload ID: 14302
  Gene Symbol: RIMS2
  Gene Name: regulating synaptic membrane exocytosis 2
  ENST ID: ENST00000626043
  CDS Start-End: 1-3181
agaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaagccaaagccttagtagaagaacaacgccttttgttcctagggttcagataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaacaatggagtcaaggagatagaaccttatgaagaactggactctacaaggagaagatatgcaggtactatggatatagaggagagaaatcgccaaatgaaaattaacaaatacaaacaggtagccggatcagatcccagactggaacaagattaccattcgaagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacggaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagcc

SEQ ID NO: 174695 - DNA, 3500 bp, Homo sapiens
  Payload ID: 14302
  Gene Symbol: RIMS2
  Gene Name: regulating synaptic membrane exocytosis 2
  ENST ID: ENST00000632716
  CDS Start-End: 137-3500
gtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggaggacaaagtggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaa

SEQ ID NO: 174696 - DNA, 3073 bp, Homo sapiens
  Payload ID: 14302
  Gene Symbol: RIMS2
  Gene Name: regulating synaptic membrane exocytosis 2
  ENST ID: ENST00000507677
  CDS Start-End: 1-1112
gaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaaggtaagatagactacttattttatttgtagggtggctgtattagtcagtgttctccagagggacaaaactaataggatatatgtatatacgaaagggagtttattagggagaattggctcatatgattataagacaaagtcccaccatagaatttctgcaagctggggaagggagaagccagtagtggcttagtccaagtgtgagtccattttgaaaggcttaaaaccagggaagctgacaggacaggcttcagtctgtggtcaaaggcctgagagccaccagcaagccactggtgcaagttccagagtccaaaggccaaagaacctagtgttggatgtccaagggcaggaagagtgaaaggaatcatccagcacaggaaaaagaaagaagccagaaaacttagcaagcaaggttatcccaccttcttcacccgctttgttccagctgcattggcagccgactggatggtggattgggtgagtcttcctctcctagtccacatattcaaatgtcagtctcctctggcaacaccttacagacacatctagaaacaatactttaccagcctaggcttccttcattccattcaagttgacacgtaatgttaatcatcaaaatggcattacagacctatttatcacatatcggtaataatctctaaagataagagattcttgtggaaaaagaatttaaggaaagcaagatggttttgtttatttaaggaaaaacaaaatgctattcaaggaaaaacaagatgctatacaataacctatgtaacgagagtaaaatgaaacatgacttgttttgtaattttagacaacctatatgttattttattgtaagagttcaaaataattcagaagaaccagttttcaatcacatattgatatgagtatatctaggtagaaccaactaattatactcatgaatgatatagataatcggtaatttaatatataggaaataatgaaaatctgactgatatttaaaattagtaacaaatatcagaatactaatttttttctttttctttttctttttcttttttttttttttttttgagacagagtcctgctctgtcaccaggctggagtgcagtggtgcgatctcggctcactgcaacctccgcctcctgggttcaagcgattcccctgcctcagcctcccaagtagctgggattacaagcgcacaccaccatgcctggctaattttttgtatttcagtagagacggggtttcaccatgttggccaggatggtcttgatctcctgacctggtgatccgcccaccttggcctcccaaagtgctgggattacaggcgagaataataatttttaaaagcatgtgcagtgggaagaatggctcagaaaatctgcagctacaggtcttaagcttactggaaatctctgatcaacctggttaagtacagacaagcttaatggaataagaatcacggaaataatagttgaagctaacaagaaatatgtgcataatttacattgtacatacttggaatgtttaagaaattttgaccagttagaatgacacacttatacatcctattttaaataaatgattatttgacttagaattttaattgagtcttaattttacacagaatattggaatgtctaagacagctttagatttattatgtttgaaggatataagacactaaaataagatttatgtaacttagacaattgcagaaattaaacaatatctgacatattaagttgacaaacatggtttaaagtgtttgaagatgttgaattaacaaagtttataaatgggaccaaaattattaaacattttttaaaagtacttaaatgtgatacacttatcaatagaataacgtgtaatctgaaatttaaagtttgagaactagttttaaatttgtaactttaataaattgaacccttccctcctctaggaaaataaaagaatacctatgtaaaaggaaaaa

SEQ ID NO: 174697 - DNA, 1408 bp, Homo sapiens
  Payload ID: 14303
  Gene Symbol: RIMS3
  Gene Name: regulating synaptic membrane exocytosis 3
  Uniprot ID: Q9UJD0
  ENST ID: ENST00000372683
  CDS Start-End: 179-1105
gcctcggcctgtggaggccccctccctgtctggaccccggccccacctccggaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaagga

SEQ ID NO: 174698 - DNA, 7235 bp, Homo sapiens
  Payload ID: 14303
  Gene Symbol: RIMS3
  Gene Name: regulating synaptic membrane exocytosis 3
  Uniprot ID: Q9UJD0
  ENST ID: ENST00000372684
  CDS Start-End: 471-1397
acggtggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggt

SEQ ID NO: 174699 - DNA, 5203 bp, Homo sapiens
  Payload ID: 14304
  Gene Symbol: RIMS4
  Gene Name: regulating synaptic membrane exocytosis 4
  Uniprot ID: Q9H426
  ENST ID: ENST00000372851
  CDS Start-End: 68-877
caagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgacttggccggttcttgacctggtggatgtggctgcagtccagagaaaggaaagattgaggtggcagagcagaccactctcccttcccaaactgtccaacttctccccctttttgcctcctcggaagctcgctgcccagagccatgtccagaacccagccggccatctccatggtgccaattaccagcaagtgtctttcctgcggcaccgggttcaggcagctactcctgccccagagatgaaggggcagctttgcaaggatccggagccagctcccaggggcccagagccccccacttgaagaggagcttgagcttccctctgcctgcccgtggaaggagctttgccgcagcctgtccgagtccatccgtccgtcccctcctgcctgcccctcttctggtggctctaggaattggggttcagcagggaccaaaggaaaggaggaggtgccgggggcctggcacagacccctaggtgcctcgctccatgggattgcaacaagctagtttaggaaccgctggcggactagaaagaatgttgtcgtctgtgttccggtggaggagctgtggaacctgagtttccagaaccccaaccctagagagcatttgggggtgctgtattggagggggaggctaaggaaagttgggattgggactggtggtgccaagataagggtttctcaaattggagaacccctccttgttgcatgaggtcaatggtcatcctgtctacccaccctgcctccaggccagggggctggggaggcaaatagagcccccctattttagtctttttaaaaaaaacatcctatactaagggcagaacccactgccccggcctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccatgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttctaa

SEQ ID NO: 174700 - DNA, 1036 bp, Homo sapiens
  Payload ID: 14304
  Gene Symbol: RIMS4
  Gene Name: regulating synaptic membrane exocytosis 4
  Uniprot ID: Q9H426
  ENST ID: ENST00000541604
  CDS Start-End: 1-813
atggagcgctcgcagagccgcctcagtctgtccgcctccttcgaggcgctcgccatctacttcccgtgcatgaactccttcgacgacgaggacgcagaaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgactt

SEQ ID NO: 174701 - DNA, 1850 bp, Homo sapiens
  Payload ID: 14305
  Gene Symbol: RPRD1A
  Gene Name: regulation of nuclear pre-mRNA domain containing 1A
  Uniprot ID: Q96P16
  ENST ID: ENST00000357384
  CDS Start-End: 153-1091
ttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttcttt

SEQ ID NO: 174702 - DNA, 4438 bp, Homo sapiens
  Payload ID: 14305
  Gene Symbol: RPRD1A
  Gene Name: regulation of nuclear pre-mRNA domain containing 1A
  Uniprot ID: Q96P16
  ENST ID: ENST00000399022
  CDS Start-End: 173-1111
actgccggccggacgccatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaatgtg

SEQ ID NO: 174703 - DNA, 1264 bp, Homo sapiens
  Payload ID: 14305
  Gene Symbol: RPRD1A
  Gene Name: regulation of nuclear pre-mRNA domain containing 1A
  Uniprot ID: Q96P16
  ENST ID: ENST00000588737
  CDS Start-End: 323-1153
atcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagagtggaggtgcaacaaatgagaaattccaattggagattttgtcaaacaggaatttactccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaa

SEQ ID NO: 174704 - DNA, 2357 bp, Homo sapiens
  Payload ID: 14305
  Gene Symbol: RPRD1A
  Gene Name: regulation of nuclear pre-mRNA domain containing 1A
  ENST ID: ENST00000585953
  CDS Start-End: 1-370
tgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacattttgcattttttaacatagacctttttaagcagtagcccaggtaagcttctccttgtattaatggtttttcttctacttgaaccaaattaatcttgcaagtaaacttagaaatttggaattagcaaaattgattgcatttaaaaattattcttgtgaaattccatgcaactataatttatcttaccagtttaaccctaatgtatcacagaaataataggaaaatagcaggtggcagtcacttgtagtaggatttatttagtttctgttttgagaagatgtagtcttttaggtataccattaagtctttaaattactcccttaattccacccgccaattctaatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctgaagcctgtattgtctcatgtttttgaaaattgaagagaagactgtaactttattctgctttatactttctcacttatgatgatggtcatttgtcactgtttacaaaaacagaatttatatttgaagtgtaactgtagaaaatagatcagatgccactccccacaacccccttttcccccagtgccttccagccacatttcatagttgacagtcatagattatgaggctgatgataataataatgttaacattcatgtgtcaggtactattctaggcacttcacataagcaactcatttaatcttacacagcaggatgtattatccacatttgatagatacagaactgaggcacaggaagattaagtaacttgcctaaggtcacaaagagctagtgagttgtttggaacgcagagaatctgcctccagagccagtgcacttcatcaaaaagacacattgcttcctgtttttacttaaatctaagattaaagcaaatgctaaagtcctattttttccaactttttctgctccctctcttctcagaggtaatcactgtcttgaaataaagccttctaggaactttttttgttgttcttctgcataactggattttatattataaagaagaaatcacctcaattatgttcagctgttttttaacaagtaaatactctttacaagtacagaaataaacttgaaagttattccaca

SEQ ID NO: 174705 - DNA, 566 bp, Homo sapiens
  Payload ID: 14305
  Gene Symbol: RPRD1A
  Gene Name: regulation of nuclear pre-mRNA domain containing 1A
  ENST ID: ENST00000592674
  CDS Start-End: 173-394
actgccggccggacgccatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagaaagagtttctgtttggagggataaacttcaaggcctttgtgaagaccaaaatggcatacaattttcctgataaatgcagtaaagtgtaaccaaaaatagtggaggtgcaacaaatgagaaattccaattggagattttgtcaaacaggaatttactccaaaccaaacaggaagcttacttttctctacctagccaatgatgtcatacagaacagcaagaggaaggggccagagtttacaaaa

SEQ ID NO: 174706 - DNA, 1945 bp, Homo sapiens
  Payload ID: 14305
  Gene Symbol: RPRD1A
  Gene Name: regulation of nuclear pre-mRNA domain containing 1A
  Uniprot ID: Q96P16
  ENST ID: ENST00000590898
  CDS Start-End: 294-1124
gaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagagtggaggtgcaacaaatgagaaattccaattggagattttgtcaaacaggaatttactccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaatgtg

SEQ ID NO: 174707 - DNA, 643 bp, Homo sapiens
  Payload ID: 14305
  Gene Symbol: RPRD1A
  Gene Name: regulation of nuclear pre-mRNA domain containing 1A
  ENST ID: ENST00000587563
  CDS Start-End: 1-150
gagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtgtttttcatgcaccatctcactgagacctcaacaaagtttttatgagttctgtctctggcgtggtctaatgtagcagcaccattactgttcctgagtaaaagcatcccgatcttgggtttttggtatcagtgtgaatttctgctcaaaagtagcaagatctcttggacagtggctgcttccatgtcaggggctgaaggagtgaagatggtcctggaacttttctttgcagagaagcaagcaggggatgccttcaaagttctgatggagctgaacaaagaagccagcttacagcttactggccaaggtttaacaacttgagcatcaaaatggaaaatacaaattgtaattaattaaaacaagtagactgtgaa

SEQ ID NO: 174708 - DNA, 425 bp, Homo sapiens
  Payload ID: 14305
  Gene Symbol: RPRD1A
  Gene Name: regulation of nuclear pre-mRNA domain containing 1A
  ENST ID: ENST00000585879
  CDS Start-End: 1-13
cagtgaagattgatggaccagcctctttccaggtcccaggactttgcaagagatggagacagtgcagagagctgtctggagtcacaatctgaacagattctcgggcgctccttctctccttccatcactacagttttatacagtggaacccatacccagagattctgtttcagaagatttgggatagatgcagaaatctgcattttaaacaagctactcagatgattctaatgcaggtgtttttcatgcaccatctcactgagacctcaacaaagtttttatgagagaagcaagcaggggatgccttcaaagttctgatggagctgaacaaagaagccagcttacagcttactggccaaggtttaacaacttgagcatcaaaatggaaaatacaaattgtaattaattaaaacaagtagactgtg

SEQ ID NO: 174709 - DNA, 1022 bp, Homo sapiens
  Payload ID: 14305
  Gene Symbol: RPRD1A
  Gene Name: regulation of nuclear pre-mRNA domain containing 1A
  ENST ID: ENST00000589050
  CDS Start-End: 154-1022
cttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcgtcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaaatattggacatgggcgtatcttctaacgatgtcgtcaccattagtatattcttcctgctaaaaataaatatcaaaccctg

SEQ ID NO: 174710 - DNA, 3874 bp, Homo sapiens
  Payload ID: 14306
  Gene Symbol: RPRD1B
  Gene Name: regulation of nuclear pre-mRNA domain containing 1B
  Uniprot ID: Q9NQG5
  ENST ID: ENST00000373433
  CDS Start-End: 403-1383
aggctcgagcggtcaaagctctttccgggggcccggggaactactctccttgcctcgctctgtctccttcgaagtgctctgcgcgaggttcagagcggccgccgcctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaca

SEQ ID NO: 174711 - DNA, 591 bp, Homo sapiens
  Payload ID: 14306
  Gene Symbol: RPRD1B
  Gene Name: regulation of nuclear pre-mRNA domain containing 1B
  ENST ID: ENST00000449186
  CDS Start-End: 1-591
atgtttcttagctacagatctgatctgcctgcatacatgtttcctggaggatcgagtccaacaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagccccc

SEQ ID NO: 174712 - DNA, 542 bp, Homo sapiens
  Payload ID: 14306
  Gene Symbol: RPRD1B
  Gene Name: regulation of nuclear pre-mRNA domain containing 1B
  ENST ID: ENST00000495457
  CDS Start-End: 117-458
gtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatct

SEQ ID NO: 174713 - DNA, 2436 bp, Homo sapiens
  Payload ID: 14306
  Gene Symbol: RPRD1B
  Gene Name: regulation of nuclear pre-mRNA domain containing 1B
  ENST ID: ENST00000462548
  CDS Start-End: 224-406
gctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtg

SEQ ID NO: 174714 - DNA, 469 bp, Homo sapiens
  Payload ID: 14306
  Gene Symbol: RPRD1B
  Gene Name: regulation of nuclear pre-mRNA domain containing 1B
  ENST ID: ENST00000622494
  CDS Start-End: 1-103
ccagctggctcggatgttggtggagtatacccagaatcagaaagatgttttgtcggagaaggagaaaaaactagagggtgtcatgattgactttggcctatgatgttggcccttaaacaccaggcaagggtggaaggaatgctgctgaaaatctgtgggtaatgtttttgtcatgaacatgagaaaacctagaaatggagaaggcacgtggaaggaagcacaaatggcagcccaaagaggaggttagagaatgtggagggtatagaagaaagcccattcagaaaggcaaaggccaaagataccagaaaagccttccagcttcacttccagagcaaagagaagctttgtttgtggttgacagaggtgactacattactcccagatgtctgctcaaagctcataagacatagcgtgagtgggttggatagggttcctgtcttgtcagcgtgaataaagcatgatacagaca

SEQ ID NO: 174715 - DNA, 659 bp, Homo sapiens
  Payload ID: 14306
  Gene Symbol: RPRD1B
  Gene Name: regulation of nuclear pre-mRNA domain containing 1B
  ENST ID: ENST00000614670
  CDS Start-End: 1-190
caaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagagctggtgactcactgatacaattatcaagccacccagccagcaccaggttgtagcgtccaaggaacagaaggattcggcacccagaacacgtgatgtcatgtttttattttgatttattttttatgtgcatgtcatgtctttctacatgacttcccaagggtggggactgtccccatcatctattcattcaacagatactcatgagtgcttcgatggtggggaatgagatgaatgaccaagtctgcacatccacggaatcgcagtctagacctgcttcatccagtactagccagactggctaccgagcacttgaaatgcagctagttcaaattgagacctgctgtcagtataaaacacacaccacatttcaaagattgagtacaaaaataagaaggtcaaataccttactaattcttatattgattacatgttgaaataatgttttggatatattggattaaataaaatacattattaaagctaa

SEQ ID NO: 174716 - DNA, 1043 bp, Homo sapiens
  Payload ID: 14307
  Gene Symbol: RPRD2
  Gene Name: regulation of nuclear pre-mRNA domain containing 2
  Uniprot ID: Q5VT52
  ENST ID: ENST00000369067
  CDS Start-End: 8-466
cgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaagtgtctttttctctcctaaaagaaaatttttgagtcagtctttacaattacataattttatagatctggtcatgttgtataatagtgaaaaattaagttttgaatctagccctatttgtttaaagttaaatatttatgaaaaatctagatctgtttgaattaaaatgtaagtagaattggttttagggatggggtcggattttgttttttagtgactacaaaagtcaagcatgttaagtggtaatagccatctggttattttcctgcatttgcgttgagtgtttcaaatggttcattgtttgtgttaataaatactgccctgtgcccttactgttggagaatttttgcacagggtgtcagttcttactaagctgtttggtagtaagcatatatcagcagtctttagactgtcttttgatttagatttacagtaagtggtgtactgttttgttaaaaggaattatgtattatatgcatgtaattaagttattgaacagaagtttgtgataatctgctaccatgaccgtcattttactagaaatttgctttaaaaatggcatcttctaagaagctgttaaattcttcattttaatttg

SEQ ID NO: 174717 - DNA, 4612 bp, Homo sapiens
  Payload ID: 14307
  Gene Symbol: RPRD2
  Gene Name: regulation of nuclear pre-mRNA domain containing 2
  Uniprot ID: Q5VT52
  ENST ID: ENST00000369068
  CDS Start-End: 5-4390
gaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtatt

SEQ ID NO: 174718 - DNA, 7605 bp, Homo sapiens
  Payload ID: 14307
  Gene Symbol: RPRD2
  Gene Name: regulation of nuclear pre-mRNA domain containing 2
  Uniprot ID: Q5VT52
  ENST ID: ENST00000401000
  CDS Start-End: 66-4373
ccgctcccgccgccgccgccgccgccgccgccagaggagcagcagcgcttgtgcaaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaagtaaagaaacacaaccaaagccatttcatttggctggggggttggggagtggggaggaaaacaatctttattttaccccatctattgaagagtattattacatttgaaataaaacttccatcagtacagataaccacatgtgcaatgttgggatgttattttgggcttggcttatcgagtagtcaatggaaggattcccgtcccctctctcggcagcttagtaactgctgtagccagctcggctcccttccctgtgtatctgtgtcctgctaacagccaagagatgttgcaagggaggaaatgtgagagaccttgaacctgtcaggtttatttgttttgtttttaaaggcatgttgaagtttagttctttacccttctcctaaaatctttttttaatcagcctcaaggttaaaataaggagtgactacagtatgtaaaataaggaaaggaagcattaatggtgtgatgtgacctgcctgtttttttgtaaacaagagaataggaaatgttttcaaggtagtttcacatgtcttgcaccaagctcatgcctcttgcttttcctttttgactttatctccctcagtttttcttctgctgtggccagaaagacagtcactacagttgactattgatacaaaggtgcaacagaaatattatccctgcatttttaaatataagaagtagacattaattttaccatggtgcctccctaatgtaagtgatatttattggtggttttcaacaaaggttaactattaaagaaagaaatatttgtctttatcttccttttccccttgcctcagtcgtgttattcacccctattcttgatattttaaaggaggagattcagtagcattttcctttatattatacacatgtgtctatcccatttcaaggctcaagtcttacccccacctctcgctcccaataggaaataaagaccatttctgcccttagttgttttacatgcaagataagtgctttccttctccctggactgaaagacttgtttgtatttctacatctagtacttgggaaatagacaatcactgtactttgagtgtttatatctttatatctagggacactgaaaagtaaatgttgctttactacaatttttttttaatttagtgtcttaccccaaggcatactcaactgataatctccagctagatgagtaaaacagtatgtgtttagttttccagagaattctggcaagtttcatattttcttccaagttagtatagaactaactataggaagtatggggttgctttttcctccagtagaatattaaagatgggggagggtgggcaatgtagtgacagaaaatgattctctcagaatgaacttttcagagaaagagcagcataaaccaggtgcacatcatgatttgggagtttttgcgtaatttattctgttatttatttgggctcgccatgtgttctggggttaggatgctgcaggtcattcatcttcttaatgcctgtctggtcttaagccaactgttctttctttcctcgaccctctctgccctgtagctctccccacaaaaatgcatgataccatgaccttacgtgtgggatggggtatgtagtgtagcaaagaaaagaaagtatagttatattgagtcctaagacatttgttagggaaaagcataagagaaaatggggtgggaggtggggaaatgatatttgactttcaaaattgaaataggttttttttttgcagaaattaaatgggatgtttttcattctagaataaaagaatgtgaattctctttgctgctcttgtttaagctaaaagtagtgtttacttgataaggctctctgaccatttaatttttatcagaaaatgtggggatgtcaggaaagtggcttcctgaacgttggggcgggataattgtcctcaaaagtatgatggttaatacatgaaaggaagactttgttggacagtttcgaaggtgggcttttaaggagttgggtttttgtggggtacttttttgttttttaagccacaaaatcctcaatatgtttgttttaggatggaagtgaggatttgtatgagactgtcagctattaattttaaggaaatcttaaaatttacatttacatcagtaaatgaagatgacagtgtgtatatatgtgataaatagtgaaacagaaaagacagttctggtattcataacgtgaaagaaaggggttttattctttctgtgtctgtgatttaaaactccgtgaccatgctctgacttttgtatttcaacctgagtttaaacaaataaacaagatattttttaaagaaagcataacatagtgtgtcttagcaaggacatgattcatatggaagcagaatgtgagaagttgtaaggtccttggtactcactgtaaaatcacagacagagaattggtaggggttgtgaatacactagtaccacttaaagttcagtgatacagttcagaaatagggtccttaagtattttgaaagagtttactcttcagtcagcttagatgagagctctctccctgctcccctctaccctctcaaaagttgagagtaaatagaatttggtttgattccagggaggggaaaataagcagagaataggacttttatactttccaataccaggaataaaatgtttgtgatatatatgggtccagcaaacctatcgagataatgtgaatacgataaacttcctaatggcaggatattcactctcaatcctgaagttaccggttcctgcagaattgagcttcagctgttactgttttgaagccgctgtaaattactgctttccccagttcccccactattttttttaagtgggcgggggcgcctgttaagatctaaaatagatatgttggattgatattctcacgtgttcggtgtggaaaacaaaacaagtacatgctttagaagcaacaacaatgaaatccttttgaaatgtgtgttaatatcgtttaataaaataactagtttgaaa

SEQ ID NO: 174719 - DNA, 2490 bp, Homo sapiens
  Payload ID: 14308
  Gene Symbol: RCAN1
  Gene Name: regulator of calcineurin 1
  Uniprot ID: P53805
  ENST ID: ENST00000313806
  CDS Start-End: 132-890
gcctgccgccgcgcgattccgagggggttaacggcggagccgccggccgggcgcggaccggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174720 - DNA, 2408 bp, Homo sapiens
  Payload ID: 14308
  Gene Symbol: RCAN1
  Gene Name: regulator of calcineurin 1
  Uniprot ID: P53805
  ENST ID: ENST00000381132
  CDS Start-End: 215-808
tgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174721 - DNA, 2526 bp, Homo sapiens
  Payload ID: 14308
  Gene Symbol: RCAN1
  Gene Name: regulator of calcineurin 1
  ENST ID: ENST00000381135
  CDS Start-End: 54-887
agaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttct

SEQ ID NO: 174722 - DNA, 2164 bp, Homo sapiens
  Payload ID: 14308
  Gene Symbol: RCAN1
  Gene Name: regulator of calcineurin 1
  Uniprot ID: P53805
  ENST ID: ENST00000399272
  CDS Start-End: 49-564
gaactatagttgaaggctgctgccaatacaacaccactgtgaaacagaatggtgtatgccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174723 - DNA, 2315 bp, Homo sapiens
  Payload ID: 14308
  Gene Symbol: RCAN1
  Gene Name: regulator of calcineurin 1
  Uniprot ID: P53805
  ENST ID: ENST00000443408
  CDS Start-End: 323-676
ccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttct

SEQ ID NO: 174724 - DNA, 2816 bp, Homo sapiens
  Payload ID: 14308
  Gene Symbol: RCAN1
  Gene Name: regulator of calcineurin 1
  ENST ID: ENST00000481448
  CDS Start-End: 488-1216
ataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccaggccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174725 - DNA, 2520 bp, Homo sapiens
  Payload ID: 14308
  Gene Symbol: RCAN1
  Gene Name: regulator of calcineurin 1
  Uniprot ID: P53805
  ENST ID: ENST00000487990
  CDS Start-End: 567-920
atgatttgtgcatcctcttttgctcgcttaggcaaattctggatttgtgttagagtggtcagaaatgccaagaacctgacttcttagattaaaagacaaaattgttggggggagaaaggttttttaatggtctgaacattttctcagttcagagcctgagatctgcatgagctcaccattgctctcgttaagtaatgttcactggctcaccgtggaaacttgaaggcatgtcagtgtacctgaaccgtgcctttttcaggactaactcaaagaccttcaggaagaaatatttgggtacagccatccgggaccacagaatcacagggcaggaatgtgaatgttgatgctggcgattgtgagctgcctgaccttaggcaagtagtctcaattcaccaagcctcctttcttcaaaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174726 - DNA, 2686 bp, Homo sapiens
  Payload ID: 14308
  Gene Symbol: RCAN1
  Gene Name: regulator of calcineurin 1
  Uniprot ID: P53805
  ENST ID: ENST00000482533
  CDS Start-End: 733-1086
tttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 174727 - DNA, 935 bp, Homo sapiens
  Payload ID: 14308
  Gene Symbol: RCAN1
  Gene Name: regulator of calcineurin 1
  ENST ID: ENST00000492600
  CDS Start-End: 76-693
acagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctgg

SEQ ID NO: 174728 - DNA, 2257 bp, Homo sapiens
  Payload ID: 14308
  Gene Symbol: RCAN1
  Gene Name: regulator of calcineurin 1
  Uniprot ID: P53805
  ENST ID: ENST00000620920
  CDS Start-End: 265-618
attttagagagttaaaaagtaacagactgagataaaagcgatcgtggaaatttttaaaaactacttattttaagaaatgcaaaactttctaccaactttgttatttttcaagccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttct

SEQ ID NO: 174729 - DNA, 3240 bp, Homo sapiens
  Payload ID: 14309
  Gene Symbol: RCAN2
  Gene Name: regulator of calcineurin 2
  Uniprot ID: Q14206
  ENST ID: ENST00000306764
  CDS Start-End: 106-837
ccagagggcgccagcgcccaccaagcgcagaagcccgggaggaccatccaggggctccccgacatttcctcagttagccagagtcggggggctcagacatctggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 174730 - DNA, 3188 bp, Homo sapiens
  Payload ID: 14309
  Gene Symbol: RCAN2
  Gene Name: regulator of calcineurin 2
  Uniprot ID: Q14206
  ENST ID: ENST00000330430
  CDS Start-End: 190-783
ctctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatgac

SEQ ID NO: 174731 - DNA, 3327 bp, Homo sapiens
  Payload ID: 14309
  Gene Symbol: RCAN2
  Gene Name: regulator of calcineurin 2
  Uniprot ID: Q14206
  ENST ID: ENST00000371374
  CDS Start-End: 193-924
agagggaggcggggcgcgccgcgccgcgtacggccccacgcaaaggcccgcgggcaccgcgccgcccccacgcgctcgcaccggcgggcaggtgagcaggcagcgccgcgcgctagcagctggcccccgtagacgccccagccgccgcctccgcctccgcctccgccggcgcatcgcggacgcccagcaggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 174732 - DNA, 2457 bp, Homo sapiens
  Payload ID: 14309
  Gene Symbol: RCAN2
  Gene Name: regulator of calcineurin 2
  ENST ID: ENST00000405162
  CDS Start-End: 194-868
gttactctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaacgctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaat

SEQ ID NO: 174733 - DNA, 960 bp, Homo sapiens
  Payload ID: 14310
  Gene Symbol: RGCC
  Gene Name: regulator of cell cycle
  Uniprot ID: Q9H4X1
  ENST ID: ENST00000379359
  CDS Start-End: 150-563
gcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcttcct

SEQ ID NO: 174734 - DNA, 3816 bp, Homo sapiens
  Payload ID: 14311
  Gene Symbol: RCBTB1
  Gene Name: regulator of chromosome condensation (RCC1) and BTB (POZ) domain containing protein 1
  Uniprot ID: Q8NDN9
  ENST ID: ENST00000258646
  CDS Start-End: 45-1640
cagagatgtcggcttatttataggaattgcttgaagccagagtcatggtggatgtcggaaagtggcccatcttcactctactctcccctcaagagatcgcgtctattcggaaggcgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacagg

SEQ ID NO: 174735 - DNA, 4033 bp, Homo sapiens
  Payload ID: 14311
  Gene Symbol: RCBTB1
  Gene Name: regulator of chromosome condensation (RCC1) and BTB (POZ) domain containing protein 1
  Uniprot ID: Q8NDN9
  ENST ID: ENST00000378302
  CDS Start-End: 262-1857
gacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggcgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacagg

SEQ ID NO: 174736 - DNA, 3232 bp, Homo sapiens
  Payload ID: 14312
  Gene Symbol: RCBTB2
  Gene Name: regulator of chromosome condensation (RCC1) and BTB (POZ) domain containing protein 2
  Uniprot ID: O95199
  ENST ID: ENST00000344532
  CDS Start-End: 425-2080
aggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaacaaa

SEQ ID NO: 174737 - DNA, 3179 bp, Homo sapiens
  Payload ID: 14312
  Gene Symbol: RCBTB2
  Gene Name: regulator of chromosome condensation (RCC1) and BTB (POZ) domain containing protein 2
  ENST ID: ENST00000430805
  CDS Start-End: 368-2038
gggcggcggtgggcagcctagggaggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagat

SEQ ID NO: 174738 - DNA, 2622 bp, Homo sapiens
  Payload ID: 14312
  Gene Symbol: RCBTB2
  Gene Name: regulator of chromosome condensation (RCC1) and BTB (POZ) domain containing protein 2
  ENST ID: ENST00000544492
  CDS Start-End: 648-1481
gggcggcggtgggcagcctagggaggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagat

SEQ ID NO: 174739 - DNA, 2984 bp, Homo sapiens
  Payload ID: 14312
  Gene Symbol: RCBTB2
  Gene Name: regulator of chromosome condensation (RCC1) and BTB (POZ) domain containing protein 2
  Uniprot ID: O95199
  ENST ID: ENST00000544904
  CDS Start-End: 260-1843
gggcggcggtgggcagcctagggaggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagat

SEQ ID NO: 174740 - DNA, 1577 bp, Homo sapiens
  Payload ID: 14313
  Gene Symbol: RCC1
  Gene Name: regulator of chromosome condensation 1
  Uniprot ID: P18754
  ENST ID: ENST00000373831
  CDS Start-End: 62-1420
ttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaaggtgcctgcgggccgagccctcctgaccagaaaacccgaccagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttt

SEQ ID NO: 174741 - DNA, 2424 bp, Homo sapiens
  Payload ID: 14313
  Gene Symbol: RCC1
  Gene Name: regulator of chromosome condensation 1
  Uniprot ID: P18754
  ENST ID: ENST00000373832
  CDS Start-End: 183-1448
ccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttat

SEQ ID NO: 174742 - DNA, 2844 bp, Homo sapiens
  Payload ID: 14313
  Gene Symbol: RCC1
  Gene Name: regulator of chromosome condensation 1
  Uniprot ID: P18754
  ENST ID: ENST00000373833
  CDS Start-End: 286-1551
gattcgcagtggtcgcttcttctccttggatttgttaaggattccaagtaactcttatttggagagaagacgatctgcacttcgcattttggcattgacatttaattttagggtcctttatatagaagggagactacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttgaattttgtttgggtatttctgttttgggagtcactggattatttttaaatgctgcatagtacaatagaggcagggtggatcttttaataccaaaccaaaaaaaa

SEQ ID NO: 174743 - DNA, 2715 bp, Homo sapiens
  Payload ID: 14313
  Gene Symbol: RCC1
  Gene Name: regulator of chromosome condensation 1
  Uniprot ID: P18754
  ENST ID: ENST00000398958
  CDS Start-End: 261-1526
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 174744 - DNA, 1121 bp, Homo sapiens
  Payload ID: 14313
  Gene Symbol: RCC1
  Gene Name: regulator of chromosome condensation 1
  ENST ID: ENST00000430407
  CDS Start-End: 273-1121
ggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccc

SEQ ID NO: 174745 - DNA, 997 bp, Homo sapiens
  Payload ID: 14313
  Gene Symbol: RCC1
  Gene Name: regulator of chromosome condensation 1
  ENST ID: ENST00000419074
  CDS Start-End: 181-997
atgggactgaagggggatcatctagaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttg

SEQ ID NO: 174746 - DNA, 903 bp, Homo sapiens
  Payload ID: 14313
  Gene Symbol: RCC1
  Gene Name: regulator of chromosome condensation 1
  ENST ID: ENST00000427469
  CDS Start-End: 214-903
ggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatg

SEQ ID NO: 174747 - DNA, 1070 bp, Homo sapiens
  Payload ID: 14313
  Gene Symbol: RCC1
  Gene Name: regulator of chromosome condensation 1
  ENST ID: ENST00000434290
  CDS Start-End: 253-1070
agattcgcagtggtcgcttcttctccttggatttgttaaggattccaagtaactcttatttggagagaagacgatctgcacttcgcattttggcattgacatttaattttagggtcctttatatagaagggagagtagctacatgaatgtgtaagatcttggaggaagacagcagagagagagagagagatcagagatcccagggttaaaagttggagaaatttcacagtacatcatccaaaagaggagtccatgatggaggcagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccggcactgcctcttccacacttcccagaggcttggatggggcaaggaggtgtggaggcagggattgtcgcatctcagagtttccaaggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccg

SEQ ID NO: 174748 - DNA, 1169 bp, Homo sapiens
  Payload ID: 14313
  Gene Symbol: RCC1
  Gene Name: regulator of chromosome condensation 1
  ENST ID: ENST00000411533
  CDS Start-End: 53-1169
cggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctg

SEQ ID NO: 174749 - DNA, 481 bp, Homo sapiens
  Payload ID: 14313
  Gene Symbol: RCC1
  Gene Name: regulator of chromosome condensation 1
  ENST ID: ENST00000486790
  CDS Start-End: 36-481
ggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggacaggaagatgtcacccaagcgcatagctaaaagaaggtcccccccagcagatgccatccccaaaagcaagaaggtgaaggacacgagggccgctgcctcccgccgcgttcctggcgcccgctcctgccaagtctcacacaggtccca

SEQ ID NO: 174750 - DNA, 2030 bp, Homo sapiens; identical to SEQ ID NO: 171465
  Payload ID: 14314
  Gene Symbol: RCC2
  Gene Name: regulator of chromosome condensation 2
  Uniprot ID: Q9P258
  ENST ID: ENST00000375433
  CDS Start-End: 48-1616

SEQ ID NO: 174751 - DNA, 4087 bp, Homo sapiens; identical to SEQ ID NO: 171466
  Payload ID: 14314
  Gene Symbol: RCC2
  Gene Name: regulator of chromosome condensation 2
  Uniprot ID: Q9P258
  ENST ID: ENST00000375436
  CDS Start-End: 189-1757

SEQ ID NO: 174752 - DNA, 2894 bp, Homo sapiens
  Payload ID: 14315
  Gene Symbol: RGS9BP
  Gene Name: regulator of G protein signaling 9 binding protein
  Uniprot ID: Q6ZS82
  ENST ID: ENST00000334176
  CDS Start-End: 858-1565
actagaggtggggttagcgcttggaagcaccgaccaacgtgagcgcaacgcggcagggacacctgaccccggcggcgcccagcccctcggattgccagtcactgctcgctttggggcacggaggtgcccagtcctgcggggcacccgacgtcctgtcgccgacagggtccgggagtcagtatagctgggttctagtcccatcacaggcaaaaactccgcgggagcctggcccgctttttacctgggcctcagtttccccatccgtaaaatagaacgggttggatctcccgagcgctaacattccagaactcggatggggcgaaggggagggagggatgggccacccacacgtgacctccccgcgtggagccccgcctaccactgatccagggggtggcagctccggccgggacgagcggggtgggcgggtcctaggaaaccctacccggccgcccttggcagcgcctaaggcggagcgcgcggctctgcagcctgcttgccccggagttggcacccacggaggatggggaccgcaccctcagcttcgcagggagccaccgtggaggccagggcggtgcagagacacgacgtgtgactcggagtgcgcctggggaggatggacgagggagcgggggaccgctaacggggctccctctgcgcgccccgtccgcagaggcgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgctggtgcgcacaggtgtggctggcgcctcctccggcgtggcggcgcgcgcgctgagcacccgcagcctgcggctcgaggcggagggcgacttcgacgtcgcggacctgcgggagctggagcgcgaggtccttcaggtgggcgagatgatcgacaacatggagatgaaggtcaacgtgccccgctggaccgtgcaagcccggcaggcggcgggcgccgagctcctgtccacggtcagcgccggcccctcctcggtcgtgtccttgcaggagcgcggggggggttgcgaccccaggaaggccctggccgccatccttttcggcgccgtgctgctggcggctgtggccctagccgtgtgcgtggcgaagctgagctgacggacacccgacggccgcctgctgctgccgctccctcccctgagaaaagactcgggatgggtgtggggtctggcctgtgcaaggggagtggtcctaaaaccccgtgtgtgcatgggtacacgcgcgtttccagtgcacatctgcctgggcaggacacggtttcctcttgctggcccgggaggagttaactttgcgccggccgtcagggcattaccgctaacgtctgcaggagctttattccctattaatagaaaaccgtcacagtgaccctagatccctccgagttaatgagttaacacatgtgctgttggggcgtctttacagggagtccgagttcggtgcccacccctgccagcgtcgccccctttctgcgtgggacagtttgaaaaggtgggtggggtggagtgaagtttggagagggacgctgtttggttctatgtggttggtctgtttcccggacaagaaaaattgcaatcaaatgtcagcagcttttattaccttaatctttcagggcctaaatttaggagagtgtcccgagagcagttcatacaaagggctttctctaagacgcgctacagcccttcctagcagagtttatccattcgtccccaagagcagctagaagagatttgaggtcatgacctcccactgccgctcaggggctgaccctatttaggaaaccaaagagggtgggttgaacctactctcacggacttggatccagtgcgcacacttgcctgcggaaaagggctctccccagccacccggagatgggggtaagaggaagagcagaggcttggggtagggccacctggtgtttaaacaggcactttctccttctctggggcttatttttgttcagaactagaccagagtgtttgaacctcctttgcaggagggctgggaatcctctttagagcacttaatcctatttatcccctggaatgtgcgtgctggccagtaggagggctggctttggcagctccctgacccccgcgctgcccgcccctccggggtaatgtggcattactggcccacagaggttttgagccaatcagctctgagactgggttagaatgtaacagctttaacttgggatttaagaagcttttaaaaggtaataatactctgaaagaaaaatgacgtaaccacagcgtgtactatgaaagctgttattttaataaagaacgctgggccatgaactcatacctgccaatgagtcaaacatagtatctttatgtagatacttagattactaaatatatatttcatctacttctgaagttgatagtcttcccccccccccacttttttcttttttgagacagg

SEQ ID NO: 174753 - DNA, 1405 bp, Homo sapiens
  Payload ID: 14316
  Gene Symbol: RGS1
  Gene Name: regulator of G-protein signaling 1
  Uniprot ID: Q08116
  ENST ID: ENST00000367459
  CDS Start-End: 67-696
gcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaagattctt

SEQ ID NO: 174754 - DNA, 1034 bp, Homo sapiens
  Payload ID: 14316
  Gene Symbol: RGS1
  Gene Name: regulator of G-protein signaling 1
  Uniprot ID: Q08116
  ENST ID: ENST00000469578
  CDS Start-End: 21-530
gcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaagtgagtattaagcttatcatcatcagtttctccataaaagaccctatatgcagaaataacatttaatatatacaacaagataaaatccttttggggtatataattttacttctacatacttaggcatataaatatagttcagtgcaatgagaatctaattttctatattggtgagggtttcagcacagtagaataaagagactgattttacaaaaccagctgccatgatgagggtgagggaagggttaagggtattgttactgaccagaactgcatgtcagggagtccttaatgagtgctcttgttttggataagaaaatgcagattagcataatgtatacaattgcagcagcaaaagtatttccaattaacagtattaccagataaatattcttggtccaagcagaaaatatcaacaaaaagagccttcttctcctgtaaatcttaaatgcctacatcactctttatgatacatggatcatcttatgtggatacttaaatttttcatgtctgcttcttttgcctctcctaactatactatgaggaaatttggaacaaagacatttttgt

SEQ ID NO: 174755 - DNA, 738 bp, Homo sapiens
  Payload ID: 14317
  Gene Symbol: RGS10
  Gene Name: regulator of G-protein signaling 10
  Uniprot ID: O43665
  ENST ID: ENST00000369101
  CDS Start-End: 29-550
ttaaaatgacagtgtctgttggccacatatgcagtctgaactttgctttgcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaa

SEQ ID NO: 174756 - DNA, 804 bp, Homo sapiens
  Payload ID: 14317
  Gene Symbol: RGS10
  Gene Name: regulator of G-protein signaling 10
  Uniprot ID: O43665
  ENST ID: ENST00000369103
  CDS Start-End: 71-616
cctcgccttcctccggctcagccgccgcgccgccgggctgctccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaa

SEQ ID NO: 174757 - DNA, 852 bp, Homo sapiens
  Payload ID: 14317
  Gene Symbol: RGS10
  Gene Name: regulator of G-protein signaling 10
  Uniprot ID: O43665
  ENST ID: ENST00000392865
  CDS Start-End: 64-567
ggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggcc

SEQ ID NO: 174758 - DNA, 2236 bp, Homo sapiens
  Payload ID: 14318
  Gene Symbol: RGS11
  Gene Name: regulator of G-protein signaling 11
  ENST ID: ENST00000168869
  CDS Start-End: 104-358
gtcatccccgccggcctcgccccgcagccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgagcccatcctgc

SEQ ID NO: 174759 - DNA, 2376 bp, Homo sapiens
  Payload ID: 14318
  Gene Symbol: RGS11
  Gene Name: regulator of G-protein signaling 11
  Uniprot ID: O94810
  ENST ID: ENST00000316163
  CDS Start-End: 78-1418
gccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgag

SEQ ID NO: 174760 - DNA, 1371 bp, Homo sapiens
  Payload ID: 14318
  Gene Symbol: RGS11
  Gene Name: regulator of G-protein signaling 11
  Uniprot ID: O94810
  ENST ID: ENST00000359740
  CDS Start-End: 1-1371
atggccgccggccccgcgccgccccccggccgcccccgggcgcagatgccgcatctgaggaagatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccaggtcaggctcgggggtgcagccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctag

SEQ ID NO: 174761 - DNA, 2390 bp, Homo sapiens
  Payload ID: 14318
  Gene Symbol: RGS11
  Gene Name: regulator of G-protein signaling 11
  Uniprot ID: O94810
  ENST ID: ENST00000397770
  CDS Start-End: 19-1422
cggcctcgccccgcagccatggccgccggccccgcgccgccccccggccgcccccgggcgcagatgccgcatctgaggaagatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgagcccatcctgc

SEQ ID NO: 174762 - DNA, 4674 bp, Homo sapiens
  Payload ID: 14319
  Gene Symbol: RGS12
  Gene Name: regulator of G-protein signaling 12
  Uniprot ID: O14924
  ENST ID: ENST00000336727
  CDS Start-End: 104-4447
agggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctgaggaccc

SEQ ID NO: 174763 - DNA, 5469 bp, Homo sapiens
  Payload ID: 14319
  Gene Symbol: RGS12
  Gene Name: regulator of G-protein signaling 12
  Uniprot ID: O14924
  ENST ID: ENST00000344733
  CDS Start-End: 905-5248
atttatattcattttttactcttttccatcaaaacataattttactaagtacgcatgttctgtgtccgtgttttgtcatcactgaagccacttttggagtcacctagtaatagcctttccactctatctagttctgtagcttttatgtgtgtaaattacttcaaatctgtttatgatcctattgctggaaactttatcccaagacacaaaaatcttttctattagaagttattaactttaaaacaattatttattttattttattttattttttgagacagagtctcgctttgtcacccaggctggagtgcagtggcacgatctcggctcactgcaagctccacctcccgagttcatgccattctcctgcctcagcctcccgagtagctgggactacgggcgtccgccaccatgcccagctaattttttttgtatttttggtagagacaaggtttcaccgtgttagccaggatggtcttgatctcctgacctcgtggtccacctgcctcggcctcccaaagcgctgggattataggcgtgagccaccgcacctggcctaaaacaattatttctttaaaaaaacataccctctattctattttgtgtcttcacaacacaatcacttactgtattgctttttaaagtgatctttaaagagtcttgcagaagagactacacagcaggcccgagaccatcctgagaggcctgtgtgcaaggctggccccccgctggtgtcaggacggtgcccaccaccctcaatgaagaggggctccctgtgcttagctgcttgtgtggggaacaagggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctga

SEQ ID NO: 174764 - DNA, 3010 bp, Homo sapiens
  Payload ID: 14319
  Gene Symbol: RGS12
  Gene Name: regulator of G-protein signaling 12
  Uniprot ID: O14924
  ENST ID: ENST00000338806
  CDS Start-End: 390-2789
agaatagattcattggcagctgtaattaaggttgtgaactgcaccacgatgctaaaaaaaacaaattctctgcagctgttttactgactgagaaattacccctgtcggccgaagttttattcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggaagtgggacccatggcagccgagacctcccagtcaacagaatcatcgatgtggatcttgtaactggctcggcgcccgggcgggatggtggcatagcgggggcacaggctggccctgggaggtcgcaggccagtggtgggcctcctacatcagacctccctggcttgggccccgtcccgggtgagcctgctaagcccaagaccagcgctcaccacgccaccttcgtctgagctgccctggcctggccaactctcctgtggacatgtcggggtggggcagcccaggtggattctgtgggcctcaggggggccaccctggccaccacaccctcaggagcccagccaggagggcagggggtgacctcgctggaggcactggccccggacattcgccatgctggccatggggctccctggccctggcctcctgctgcccaataaagcatttctga

SEQ ID NO: 174765 - DNA, 5512 bp, Homo sapiens
  Payload ID: 14319
  Gene Symbol: RGS12
  Gene Name: regulator of G-protein signaling 12
  Uniprot ID: O14924
  ENST ID: ENST00000382788
  CDS Start-End: 104-4234
agggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagtctgcaactgtgtctgatggcgagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgagaagaagcggaaaggcgcgtttttctcgtggtcgcggaccaggagcaccgggaggtcccagaaaaagagggagcacggggaccacgcagacgacgccctgcatgccaatggaggcctgtgtcgccgagagtcgcagggctctgtgtcctctgcggggagcctggacctgtcggaggcctgcaggactttggcacccgagaaggacaaggccaccaagcactgctgcattcatctcccggatgggacatcctgcgtggtggctgtcaaggcgggcttctccatcaaagacatcctgtccggactctgtgagcggcatggcatcaacggggcggccgcggacctcttcctggtgggcggggacaagcctctggtgctgcaccaagacagtagcatcttggagtcaagggacctgcgcctagaaaagcgcaccttgtttcggctggatcttgttccgattaaccggtcagtgggactcaaggccaagcccaccaagcccgtcacggaggtgctgcggcccgtggtggccagatacggcctggacctcagtggcctgctggtgaggctgagtggagagaaggagcccctggaccttggcgcccctatatcgagtctggacggacagcgggttgtcttggaggagaaggatccttccagaggaaaggcatccgcagataaacagaaaggtgtgccagtgaaacagaacacagctgtaaattccagctccagaaaccactcggctacgggagaggaaagaacactaggcaagtctaattctattaaaataaaaggagaaaatggaaaaaatgctagggatccccggctttcaaagagagaagaatctattgcaaagattgggaaaaaaaaatatcagaaaattaatttggacgaagcagaggagttttttgagcttatttccaaagctcagagcaacagagcagatgaccaacgtgggctgctaaggaaggaagacctggtgttgccagagttcctccgtttacctcctggttccacagaactcaccctccccactccagctgctgtggccaagggctttagcaagagaagcgccacaggcaacggccgggagagcgcctcccagcctggcgagcagtgggagccagtccaggagagcagcgacagcccgtccaccagcccgggctcagcctccagcccccctggacctcctgggacgaccccccccgggcagaagtctcccagcgggcccttctgcactccccagtcccccgtctccctcgcgcaggagggcaccgcccagatctggaagaggcagtctcaggaagtggaggccgggggcatccagacggtggaggatgagcacgtggccgagctgaccctgatgggggagggggacatcagcagccccaacagcaccttgctgccgccgccctccaccccccaggaagtgccaggaccttccagaccaggtacctccaggttctgatccctccaccttggccccgtaagcgtggtctgctcagcttccagtcagaaaggacagtgggcccccggctgccactgtttgctggtggtctccgtgaccccctcctcacctgctggttgggggcttccttggccctcttggaaaggaggggctcgtgtggccccaggccagtgtctgtcaggatggtccccccgaggcgctctgggcaggcatcctggtgtcctgagaggctcttgcaggaatgatacgtggcagtgcctgcagcgaggtctgggaacaccctgggtgaggcctgggggtttccgaaaatggaggcattcctttccaaatctggacagcgatcgtttttagtgtttctgtctcaagactggaaaacaatagcatttgtcttgagtgaggaagtgaagcccgctgtgttcatagcaggagagggctcccagacacaggcccgtcctcggaagagccttgagagtgcagctcggacccaccggcggcccccgtagcaggtggtgtgggtgctcgggagtggaggtgacgtcagcagcgctctctgaccgcgggtgtcacgggcatttctcaaaggaagcaggggattcagtgagtgtgaaggtgaacaggatggcctggcagcagggatgtttccgtgagccacaaataccagaaactgaggcgaggctcccagcagccggtagggaaaggtgtttccaggggtccgagggccgtggcctgcgtggccatcccctggagagaggagccgctcagggtgcgcgtcatggagtgtgctcaggggtgcgtggacacctctgctgtggtttgctgctgggggcgatgggagcgcctctccgtcctgtgccctggtccaggatgctgacagcagtgagaggcctgccgtgaggtttggtcttgtcagacctgtagcctggacctcgccgggggaccagggagtgcacgtctgtagatctgtacatatctgggcctttggaggccacgtgtggcatgggaggggctacctggtccctttcacagccaggacacgcctggatgagaaagcctgaggtgcctggcatgcccaccggtgccactctgcagcctccacccctggcctgagtccccctccatccgtcttggtggacacctgtgtggctctcacctgcgttttgagtctgttcttccaggagtaataaattctggacatcatcactggactggcttacaacttttctttctcatttgaaactttgtttccactttagaaaataataaaagtattttaatcta

SEQ ID NO: 174766 - DNA, 2751 bp, Homo sapiens
  Payload ID: 14319
  Gene Symbol: RGS12
  Gene Name: regulator of G-protein signaling 12
  ENST ID: ENST00000514268
  CDS Start-End: 104-2107
agggcactgtttgaagaagcaaacatggtagcatcaagcattccttgaaatatggctccaagggaacaatgagacgtgctcttggtcttggaagctcatcagaatgtttagagctggggaggcctccaaacgcccattgcctgggccgtcgcccccaagggtgcggagtgtggaggttgcccgggggagggccggctacggattcacgctttcgggacaggcaccctgtgtgctcagctgcgtcatgagagggagccctgcggatttcgtgggcctccgagctggagaccagatacttgctgtcaatgaaatcaacgtgaaaaaagcatctcatgaagatgtagtgaaattaattgggaagtgctctggtgtccttcacatggtgattgctgaaggcgtcggccgcttcgaatcctgttccagtgatgaagaagggggactctatgaaggaaaaggctggctgaagcccaagctggattctaaagcactaggtataaacagagcagagcgagtcgtggaggaaatgcagtctggtggaattttcaatatgatttttgaaaacccgagcctttgtgcgagcaattcagagcccttgaaattgaaacaaagatccctttcagagtcggccgcaactcgatttgatgttggacatgaaagtataaataatccaaatcccaacatgctttctaaggaggaaatatcaaaagttattcatgatgattcggttttcagcattggactagaaagtcatgacgattttgcattggatgcaagtattttaaacgtggcgatgatcgtgggctacttaggctccattgagcttccttccacgagctccaacctggagtccgacagcttgcaagccatccgcggctgcatgcggcgcctgcgggcagagcagaaaatccactcgctggtgaccatgaagatcatgcacgactgtgtgcagctgagcactgacaaggctggagtcgtggccgagtacccggccgagaagctggccttcagcgccgtgtgcccggacgaccggcgatttttcgggttggttaccatgcagacgaatgacgacgggagcctggcccaggaggaggagggcgccctgcggacttcctgccacgtgttcatggtggacccagacttgtttaatcacaagatccaccaaggcattgctcggcggtttgggtttgagtgcacggccgacccagacaccaatggctgtctggaattcccggcgtcctccctccccgtcctgcagttcatctctgtcctgtaccgagacatgggtgagctgattgagggcatgcgggcccgcgcctttctggacggggacgccgatgcccaccagaacaacagcaccagcagcaacagtgacagcggcattgggaacttccaccaggaggagaagagcaaccgggtccttgtggtggacctgggtgggagctcgagcagacacggccccggaggcagcgcgtgggacggtgtgggtgggaggggtgcccagccctggggtgctccctggactgggcccttctgtccggaccccgaagggagccccccatttgaggccgctcatcagactgacaggttctgggacctaaacaagcacctagggccagcctctcctgtggaggtgcccccagcttccttgaggagctcagtccccccttccaagaggggcaccgtgggtgctggctgtggtttcaaccagcgctggctcccggtccacgtgctccgggagtggcagtgcggacacaccagcgaccaggactcttacacagattccaccgatggctggtccagcatcaactgcggcacactgccccctcctatgagcaagatccccgcagaccgctacagggtggagggcagcttcgcgcagcccccgctgaatgccccgaagagggagtggtccaggaaggcctttggaatgcaaagcatttttggtccccatcgaaatgttcgaaagactaaggaagataaaaagggctcaaaatttgggcggggaactggactcactcagccttctcaacgcacgtctgctcggagatcatttgggagatccaagagattcagtatcactcgctcccttgatgatcttgagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgattttctaaggaaagaattcagtgaagaaaacattttattctggcaggcctgtgaatattttaatcatgttcctgcacatgacaaaaaggagctttcctacagggcccgggagattttcagtaagtttctctgcagcaaagccaccaccccggtcaacatcgacagccaggcccagctagcagacgacgtcctccgcgcacctcacccagacatgttcaaggagcagcagctgcagatcttcaatctcatgaagtttgatagctacactcgctttctgaagtccccgctgtaccaggaatgcatcctggcggaagtggagggccgtgcactcccggactcgcagcaggtccccagcagcccggcttccaagcacagcctcggttcagaccactccagtgtgtccacgccaaaaaagttaagtggaaaatcaaaatccggccgatccctgaatgaagagctgggggatgaggacagcgag

SEQ ID NO: 174767 - DNA, 1505 bp, Homo sapiens
  Payload ID: 14320
  Gene Symbol: RGS13
  Gene Name: regulator of G-protein signaling 13
  Uniprot ID: O14921
  ENST ID: ENST00000391995
  CDS Start-End: 289-768
tcatactgaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgatgatattctaacgctgccttttctcttctcattttagagaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 174768 - DNA, 1518 bp, Homo sapiens
  Payload ID: 14320
  Gene Symbol: RGS13
  Gene Name: regulator of G-protein signaling 13
  Uniprot ID: O14921
  ENST ID: ENST00000543215
  CDS Start-End: 256-735
agaacattcatactgaggccagagtgccatcgaaggtaattatagagacagtaaaatccttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaagacttacattatctttctcaaagacaaaataaatatattttccagt

SEQ ID NO: 174769 - DNA, 2415 bp, Homo sapiens
  Payload ID: 14321
  Gene Symbol: RGS14
  Gene Name: regulator of G-protein signaling 14
  Uniprot ID: O43566
  ENST ID: ENST00000408923
  CDS Start-End: 189-1889
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccatga

SEQ ID NO: 174770 - DNA, 1536 bp, Homo sapiens
  Payload ID: 14321
  Gene Symbol: RGS14
  Gene Name: regulator of G-protein signaling 14
  ENST ID: ENST00000511890
  CDS Start-End: 1-1313
tgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgca

SEQ ID NO: 174771 - DNA, 2427 bp, Homo sapiens
  Payload ID: 14322
  Gene Symbol: RGS16
  Gene Name: regulator of G-protein signaling 16
  Uniprot ID: O15492
  ENST ID: ENST00000367558
  CDS Start-End: 150-758
gcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccacgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 174772 - DNA, 1636 bp, Homo sapiens
  Payload ID: 14323
  Gene Symbol: RGS17
  Gene Name: regulator of G-protein signaling 17
  Uniprot ID: Q9UGC6
  ENST ID: ENST00000206262
  CDS Start-End: 152-784
ctctcctcgcccgctgggtgctgaagttgggcggatggcagcaaaccggctccgctagaggaccgagccgcccagccccgctcccccggacccatcggcgcgctgcccacacctccaggcgaccggccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcacaaaacaatttgaagatatcctatctcaatgacaaatcaaaagagtgatattgcttttaactgtaatagaagaaaatgaatttatgtatatatcagatgtccaatactgtaattaatttattaaagactggctctccagtttt

SEQ ID NO: 174773 - DNA, 7773 bp, Homo sapiens
  Payload ID: 14323
  Gene Symbol: RGS17
  Gene Name: regulator of G-protein signaling 17
  Uniprot ID: Q9UGC6
  ENST ID: ENST00000367225
  CDS Start-End: 26-658
ccaactgggtcctgaagtagctgaaatgcgaaaaaggcagcagtcccaaaatgaaggaacacctgccgtgtctcaagctcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcacaaaacaatttgaagatatcctatctcaatgacaaatcaaaagagtgatattgcttttaactgtaatagaagaaaatgaatttatgtatatatcagatgtccaatactgtaattaatttattaaagactggctctccagttttaaaatggttgtgtaaagttatgtacttcagcaagaaaaaaataataataagcttgataacttagttttggaatataaagaaaaggacttaataaaggaatgcctacatgtagcactgtaaaacattttgatgaatagcatctgtcctgtggcatattttccttgaaagtgaaatccaatgaaaagctaagtttttaccaggaaaagttttataagggttatgaagaaaataatcctctacttcagaccttaactgttttcacataatatcttaaggatgacattttaaagatgtttaaaccaaactattagttttcatccatcattaaaaggcagtacagtgctcaaatcttccagctgccatattattttttataagtacactaaatctttacgacaaaacacttgcctgacattgtcatgtacttctgaccttcaaggaaacaatattctgtcatgcataaaagtgataattaaaataatcagtgtcatatttatatcaaagtgttacatttgaatattaatatcccctgaagactatttttttaatattaaactgaatgaatataatactgagtaacctaaaatgaaagttttaaaaagatttatatccactgagaacactggccttatattaaggatgatattacagttacaggttttctttgtcatttttttaactacctctcattttttaatttattaaacatattttttaaaaaaacaagtttgggggtttctttttaaatttattttacttgaaaggttggcatcacaagtttctttttccataaacttaaaacatttcaaaaatggtttttttaagcaagtatgattttctaatttatatagaattcaggagacatgaataaaagggctattatctattccctatgcaaatattttaactgttgcagtgtttgacaaaatgggattttttaaaaattgcagagtagaaaacaaaatattctgtttacactggcgttgctgactatcctaccatattcagcacttttaaatacgttatttatgaaaatgcagttaaaatgcaagatagaaaatatttataataatcatttcttttaacaaatgcctgtgttttctgaaagtgttagtgtgttaagacatattttattcatgtcatttaaatactatttgaataagttttcagtaatatgttgaaaaaaagatagctatgaagatgtttacaaaaagtcatattttttcctaaagagtaaagaaaaacctaaaagaatcatcacttctattgtgaagttctattgttcctaaattatttaatttttttcttgcttagaattgagtttattatgctactatgatatatacacatgtatggtgtagtatcatatttgtttctgtgtgtgaggctcaacaaattggtgcacatgactagaaaatatgtaatatactgtgatacactgcatgcatccatctttttaaatgtagactttatattctcgttgttactatatatgatggtgacctgctagtcataagttatctttataagatactttggactattagatgaattgtctgtttgacaatatctttaatattttaccaaatgtaaaagataagggccgttataaagagtcctaatctctaacctgggcatttgtagaacacagattttaaagttggtatatccttttgaaacctgatgaggaagttgagttaaaaaagattcgagagcagatttacacatcagatgttgataaccatgctatgtgagcatttctgtgctaaactcgtatttttgggtgaggggagggtttctcatttaagagtatgtctgtatatttgcaactctactaattttctaagtatgatataattccttctgtttaagttacagagctattataaataaacaaaagagccttcaactggtgtctatgctaccattccaagagcacaatatttgttttcttagaatttgagttttcctagtgagtaaattcctccctggggaaaaattagcactttaaaatggacactttgtgttttcaattgccaaggtatctttgtatactattagaatttgctgatgcacacagaaagagattaatgcactttctatagtgcctaactttagatgtatctataaaagaaagtagaggatacagattatgtatatataaataaattggagagccagatttcttcagagattgatcttgtacattaatcacaccagtaatggatggatggcacttctttactcgggctgttatgatgttatccaaaggtagtagagatgctctgacagtgttggagtgtgcacatgaacaacaagagcaaaacacaactttgatactaaagttacgaaatgcagaagtcaagaccataatgtgatgttttttttttttgaaatcttaaaatatgtacatagaatgaccagttctgatatgccgtcttagtgcatggatgtttattagtatcctttaatgctgcctaggttctgacttacagaatgaaatacgtgttgtttatctacctgatagttcagttttgccaaaggactatagggataagtgaataatatttatttattaggagcaaaaatacattttcatcccattaagctaatttaaaataatgcctgatttttacttttgagtttatccatttttctatacctttaacttatttatactttaaaaaatcatattgtaattgtgacaaattatatctcaaaaaataccaattattagatgctttggtgttgaaatgtaaaagagaaggaatttaaaatacaatcaaaaaagtcaaaaataaaacgtatttgaaaaccacctaaaatttcttggccaggcacagtggctcaagcctgtaatcccagcactttgggaagccaaagagggcggatcacttgagctcaggagtttgagaccagactggccaacatggtgaaaccccgactctagtaaaaatacaaaattagccgggcatggtggtgggtgcctttaatcccggctacttgagaggctgaggcaggagaatcgcttgaacccaggaggcagaggtcgcagtgagctgatatcatgccactgcactccagccttggcaacagagtgactccatctcaaaataataataataattataataataatatttttaagtcttagacagaaaatgcctatagatagaagcctatcaaacatgtattttgaatactttgatcttgacacattgcctaattattttgaaagatggtaaagatatttccaaaaaatattttcgcctatctgtttacattgacagtttacaaccataattttctaagtatatttttcaaacatgtatttttgtgttttccatcttcaaatttctgaccaatgggtttgttctcctgcaaaaacaatatccaatctgcaaaaatttttaattcttcacttgctacaactgcaaatatttatcaataaaactgataacccaaaacttgcttcagattttccctgcagtgcttaaaatatccttgcaacacaagatggtgcacaatgacaagtattatttctgaatacccagatttgatttatttataggtatttttgaaattattactcttacaggtgtagtcctctccagccccaagtaacatcttttcagatgaattcaagaggctgttcaagactttgactctactgaaaacactacaaaaggcaaaatgttgccctaggtgatagaaggtcccagtttgggaactgattttcttcctatgacaaaagctataagatgagtaaggttactaatggaaatgtatgtccacagattcacttagggagcatagtgtaaaaacatcaggaacttaaaattacaaatttgatttcaagttatatttctgtctcatgtgactttgggcaaatcatttatcttctctgagttcatttcctcatctgcaaatgacaaataaaatacgtaattatcaggataactatgagcattaaataaaacaaacgtggaaagaataaagtgtggcatacattattattttatcaaagtgcatcacgtcaataattgttattgtatacttgtattaaatgtcactttaatgcactttcccctatttttttccaaaacatacgttaaacatctgatttagctactcatcaaaacatacaatcatgttttaagatggaacactatatcagtgttactgcttttctcaataatgtgatcccaaatcagtactttcagttcaccatcacctcaaatctatagaaatgtttctttcaatgacatagatagatagatgattgatagatagatgatagatagatgataaatggatatacaattataggttaaaattaaagtttaaataagatcaatcatttgaaagttttatttccaaaggaaataaaacaacattcccaaggacagaaataatatcaaattacttgctaaatatataaatgagttatagggctaagactaagttataagagattgacaattagaaaacactctttttaatattaaggtggtatgattttctttaacaattttacaatgaaaataaaaacttaataaaaggtggtaatgggccaggcacggtggctcacgcatacaatcccagcactttgggagactaaggcgtgaggatcacttgagcccaggagttccagacatgtctatgcaacaaagtgagaccctgactctaagaaaaaaataaaatgtataaaatttaaaatagtaatgtgtccattaaaccttttattttagagtagttttagatttacagaaaaactccaaatagagaggtcccatatacatctatgggcattaatgagccaatattgatcattacattcatacttcattcagatttccttagtttataacctaatgtcctttttctgtcccaggatcccattcaggataccacattacatttagttgtcatgtttccttaggcttcccttggctgtgacagtttctgcaactttccttgtttttgatgacagttttgagaaataaactggtattttgtagaatgtccttctatggggattcgtctgatgtttttctcgtgactagacacaggtttttggtttttgaaagaacacaacggtaaagtgccatgctcatcacatggtatcaaaggtatatgccatcaccgggactcgtcttagctgtgacagtttctcaaactttaggctactcttagctgttgatgttaaccttgatcacttagctgaggtagcatctattatatttctccactgtaaagtaatgcgtttttaaagagattatattgaaggtaaattttctggacatttacactgagctaaacaaattctaaacactaatattaggttccactaagtgattactaataaatgctataaagaaaatacagtgaagtggaaaaataaaactccagaagtcttagcctgaatattcacctaatagaggtgaaagtgaatttttcccttgaactgtctgcgcaatttacaataatcctccacatactttggatattaaagatcttatcttactaattgtcataagaggtaatttaaatttaaactaaccattttgcttattgcatttttatattgccctccactaatcaatgaacactgaatattgaaataatgtaaaagacctatttcccgctagctttaaccgatttgtcataaacacctttcttgtatatgatttttaaatgtttgctaaatattaaaaagaattcaatgtgtttggttttgtaaaattacatatcgaatgtgtataattttttactaccatgttcatcacacttaatctatatccatatattgtactccaccaatatttatcagtggacaataaagaagttttgaatgcatgaatgcaacttaagaggcaccacacttggttattttgcaatgccagaataacggtgggtattcacaaattgaatagataatccagattatgtttcctccaatttaagtttttctgggtttttttttcccccttcctagaatcaattttatcattttacctatgtacaataatatacttctggaaaatgctagaattttcaccatgtaacagaatttgagcatgacagtaatgtaaaaatattcagaagtctcgaactataggtttgagttttcaaagtaaatcaaaatacagctgttttcattttactagattgtggaaacctatggatgttattgtaaaatgcatatgcattacactgactttcttaaaatgttttgaattaataaagaattcaacaatgta

SEQ ID NO: 174774 - DNA, 2150 bp, Homo sapiens
  Payload ID: 14324
  Gene Symbol: RGS18
  Gene Name: regulator of G-protein signaling 18
  Uniprot ID: Q9NS28
  ENST ID: ENST00000367460
  CDS Start-End: 182-889
tcctcagttctgcatttctgcagagacagaaagaaacgcagctcttgacttcttttttgtaaacattactgtaagagttgtgataactttttattctactatgtatatgtatggaatagtattaataaatgaactagggaaggatgtaataaattagacatctcttcattttagagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatggactagaggcttttaccagatttcttaaaactgaattcagtgaagaaaatattgaattttggatagcctgtgaagatttcaagaaaagcaagggacctcaacaaattcaccttaaagcaaaagcaatatatgagaaatttatacagactgatgccccaaaagaggttaaccttgattttcacacaaaagaagtcattacaaacagcatcactcaacctaccctccacagttttgatgctgcacaaagcagagtgtatcagctcatggaacaagacagttatacacgttttctgaaatctgacatctatttagacttgatggaaggaagacctcagagaccaacaaatcttaggagacgatcacgctcatttacctgcaatgaattccaagatgtacaatcagatgttgccatttggttataaagaaaattgattttgctcatttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaa

SEQ ID NO: 174775 - DNA, 1510 bp, Homo sapiens
  Payload ID: 14325
  Gene Symbol: RGS19
  Gene Name: regulator of G-protein signaling 19
  Uniprot ID: P49795
  ENST ID: ENST00000332298
  CDS Start-End: 185-838
gggaagtgccgccgaggcgcctgcgcactgcgcccccgcgccccctccccgactgtcgggccggaccttggagcgcgcgggccggcggcggcgcgagtggctcgggagcgcggctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaa

SEQ ID NO: 174776 - DNA, 1593 bp, Homo sapiens
  Payload ID: 14325
  Gene Symbol: RGS19
  Gene Name: regulator of G-protein signaling 19
  Uniprot ID: P49795
  ENST ID: ENST00000395042
  CDS Start-End: 268-921
agctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccacccatgcccaccccgcatgaggctgagaagcagatcacagggccagaggaggcggaccggcccccttcaatgtccagtcatgatacagcctctccagcggcccccagccgcaacccctgctgcctgtgctggtgctgctgctgtagctgctcctggaaccaagagcggcggcgcgcgtggcaggcctcccgggagagcaagctgcagcccctccccagctgtgaagtatgtgccacgccaagtcctgaggaggtgcagagctgggcgcagtcttttgacaagctgatgcacagcccagcgggacgcagcgtgttccgggcgttcctgcggacagagtacagcgaggagaacatgctcttctggttggcctgcgaggagctgaaggccgaggccaaccagcatgtggtagacgagaaggcgaggctcatctacgaggactacgtatccatcctgtcccccaaggaggtgagcctggactcccgtgtgcgggagggcatcaacaagaagatgcaggagccgtccgcacacacgttcgacgacgcgcagctgcagatctacacgctcatgcaccgggactcctacccccgcttcctcagctctcccacctaccgtgccctgctgctgcaggggccatcacagtcctcctccgaggcctaggccgcccccagcagcacagaccccgccgcctcctacggccgactctgggttcccttcaggtgttgttgtcggcagggctgtcagggcacatgcctggccggctggggtccccacccgcggagacggtcctagacccagtggggagtgctgtgtctcctgggtctgcccacccgtggccaagcaggaactccaggtgcagggcgggcctccaggtgcagggcgggccagaagccccctcatcggcccgcagctggctggcccagtgctcctggctgggggctcttgcgtggtgagagtaggggtccccccaggagccatgctggacccatgagcctcgctggggcctcctccccaggcagccaatgggccccagacaagcctttggtggggaacagaacctccgcatcgtgtagttttgtgacataaggagacctcctacttgagctgtctgtaccccagaatcaaacacagaacctcagaaccagatttaggacctcagaatcctgcactcaaggtggcaggacccaatttctgttttatatgttcatgaactttaaacctggaaacatgtccttactaggtgttttatcaaaaaaaagttttcatatttatctctatccctaaccccccaaaaataggatgtcttattattgaagatatttttaaagcaaa

SEQ ID NO: 174777 - DNA, 1354 bp, Homo sapiens
  Payload ID: 14326
  Gene Symbol: RGS2
  Gene Name: regulator of G-protein signaling 2
  Uniprot ID: P41220
  ENST ID: ENST00000235382
  CDS Start-End: 32-667
aaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacacttgga

SEQ ID NO: 174778 - DNA, 1664 bp, Homo sapiens
  Payload ID: 14327
  Gene Symbol: RGS20
  Gene Name: regulator of G-protein signaling 20
  Uniprot ID: O76081
  ENST ID: ENST00000276500
  CDS Start-End: 123-848
gggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctccagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaa

SEQ ID NO: 174779 - DNA, 2104 bp, Homo sapiens
  Payload ID: 14327
  Gene Symbol: RGS20
  Gene Name: regulator of G-protein signaling 20
  Uniprot ID: O76081
  ENST ID: ENST00000297313
  CDS Start-End: 93-1259
cattaaccaaacaaagagaagcagagtggatcctgtgctaatattgggaaaaccaggcaacaggactcatttggggcctttattgtgaaaacatgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtccttcccgcctgcacagctcccagactcgcccgccgccccgaagctgttcggcctcctttctagcccgctttccagcctcgcaaggttcttctctcaccttctccggcgaccccctcccgaggctccccggaggcgcctggacttctcccccctgcttcccgccctgccggccgcccggctctcgagggggcacgaggagctgccgggccgcctctcgctcctgctcggggcggcgctggcactgcccggccgaccctcggggggtcgtccgctgaggcccccccatccggtagccaagcccagggaagaagacgccaccgctgggcagagctcgcctatgccgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 174780 - DNA, 1667 bp, Homo sapiens
  Payload ID: 14327
  Gene Symbol: RGS20
  Gene Name: regulator of G-protein signaling 20
  Uniprot ID: O76081
  ENST ID: ENST00000344277
  CDS Start-End: 1-822
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 174781 - DNA, 1518 bp, Homo sapiens
  Payload ID: 14327
  Gene Symbol: RGS20
  Gene Name: regulator of G-protein signaling 20
  ENST ID: ENST00000517659
  CDS Start-End: 1-177
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 174782 - DNA, 1434 bp, Homo sapiens
  Payload ID: 14327
  Gene Symbol: RGS20
  Gene Name: regulator of G-protein signaling 20
  ENST ID: ENST00000523280
  CDS Start-End: 1-213
atgccccagctttcccaagataaccaagagtgcctccagaaacatttctccaggccgtctatatggacacagtttctgcccctgttcagggctcagagatataatacagacattcaccaaatcacagaaaatgaaggagacctcagggctgttcctgatatcaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctcaa

SEQ ID NO: 174783 - DNA, 1559 bp, Homo sapiens
  Payload ID: 14327
  Gene Symbol: RGS20
  Gene Name: regulator of G-protein signaling 20
  ENST ID: ENST00000522225
  CDS Start-End: 353-721
agagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctctctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgcgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaatttt

SEQ ID NO: 174784 - DNA, 1794 bp, Homo sapiens
  Payload ID: 14328
  Gene Symbol: RGS21
  Gene Name: regulator of G-protein signaling 21
  Uniprot ID: Q2M5E4
  ENST ID: ENST00000417209
  CDS Start-End: 175-633
gttaccacttggaaaacaattcatctgaaagaagcacagattttctcatctatcctgtcaacaaagaaggaatcaagagagcaaggacagtgatttcccctgcattgcatttgtcttgaagatcagtcagaaagagaaactcggcatcatctgtgacagacagtggaacgaaaaatgccagtgaaatgctgtttctacaggtcaccaactgcggaaacaatgacatggtctgaaaatatggacacgcttttagccaaccaagctggtctagatgcttttcgaatatttctaaaatcagagtttagtgaagaaaatgttgagttctggcttgcctgtgaagactttaagaaaacgaaaaatgcagacaaaattgcttccaaagccaagatgatttattctgaattcattgaagctgatgcacctaaagagattaacattgacttcggtaccagagacctcatctcaaagaatattgctgaaccaacactcaaatgctttgatgaggctcagaaattaatctattgtctcatggccaaggattctttccctcgatttctgaagtcagagatttataaaaaactggtaaatagccaacaggttccaaatcataaaaaatggctcccttttttgtgaggaaggtaaaagttaactaatcactatacttcagggctacaatattttaaatatacaagcatgatgcattgtcttttgttttgtttttaggatttagaaaacattttttacccaaacagatgaataacgttttatacaacaagcctgaatttctaactcagttgtttagaatgtatttgctttaccagctatttaatctcctactgggggagtacaaagaaagtttatagagatacaatatagtcttaaaccaaaactgaatattcttattatattataatgtaaggaattatacatatcttcacgtggcagaatgaaagacttttgagcatcatatacacaattttaaataccattgctttattcaaaaaaatctcacttttgtaaaaagagaatttctgaaccaaaatacaagctttcatttaatatatttaactgttttttttctgccatttctttccaactatttctaataatgtggttatgaaaactgctacgcctctcaaattatattttttaaatcacaggaatgtatacacatttatatgtatgtcttgaatgcaccatggaccaaagtttttcaaaatatatcacttggctcaattcaatggcatcacatataaaatgtgatgagttatgtatgaaaaggcctcaagggtggggaatactgattttcttatgttaacagaaatataaaagaaagtggaagactaaggagcatagataaatccttataagatgaagtatatagcaagtcataaaatttaagaatttgcaacattatctactcaattgtggggaagtatctattcactccttcagcactgatacttgtttataaaacccaaacaatttttaaatgcatttattttgagatgttcctaaaattgtttcattctatatgtaaatatcctgtgataaatacgaataatttcatttcaatatgagaagctgtaaagattcaacagatctcccacgtttccattttctttgcacagatttatttatctgcattgatatttctgcttttagattgtttgaacattaaaaaatggaggaaaaatagcatggcttattttatgttttcacaaactactcatttgatagacaaaattttgtcttcccttcatcatgagaaataaacatttaaacatattcaaa

SEQ ID NO: 174785 - DNA, 4296 bp, Homo sapiens
  Payload ID: 14329
  Gene Symbol: RGS22
  Gene Name: regulator of G-protein signaling 22
  Uniprot ID: Q8NE09
  ENST ID: ENST00000360863
  CDS Start-End: 196-3990
ccggcctcggcctccctgggcggccgtattgtctaagctccatagcaaccccggcgcggcgccggccacgctagccagcgtagctccggagcccgcgcgccgtcgccgcgtcgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtcttactctcgcagttttaaaattatagctattctgtacacatgacatacaagactataagaactgtttaacttatttagaataaaacaactactatctaggtttgaagaaccaaaa

SEQ ID NO: 174786 - DNA, 809 bp, Homo sapiens
  Payload ID: 14329
  Gene Symbol: RGS22
  Gene Name: regulator of G-protein signaling 22
  ENST ID: ENST00000517828
  CDS Start-End: 1-809
atggactgtggagccagaggagtagaaggagcaatggaaacctggcaggaagattctctggcaacagatgatttccttgtagactactttaatgaattcctaagccttccatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatcca

SEQ ID NO: 174787 - DNA, 2408 bp, Homo sapiens
  Payload ID: 14329
  Gene Symbol: RGS22
  Gene Name: regulator of G-protein signaling 22
  Uniprot ID: Q8NE09
  ENST ID: ENST00000519725
  CDS Start-End: 80-1594
aggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgagacaagcttggtatgttgtccaggctggtttgaactcctggcctcaagcaatcctcccaccatggcttcccaaaatactgggattacagggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaa

SEQ ID NO: 174788 - DNA, 564 bp, Homo sapiens
  Payload ID: 14329
  Gene Symbol: RGS22
  Gene Name: regulator of G-protein signaling 22
  ENST ID: ENST00000519408
  CDS Start-End: 319-564
ttcgctgccagtggagtctcgagggacacaggcgtctccagggcgccccttccggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacct

SEQ ID NO: 174789 - DNA, 3975 bp, Homo sapiens
  Payload ID: 14329
  Gene Symbol: RGS22
  Gene Name: regulator of G-protein signaling 22
  Uniprot ID: Q8NE09
  ENST ID: ENST00000523437
  CDS Start-End: 42-3800
gacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaa

SEQ ID NO: 174790 - DNA, 513 bp, Homo sapiens
  Payload ID: 14329
  Gene Symbol: RGS22
  Gene Name: regulator of G-protein signaling 22
  ENST ID: ENST00000520117
  CDS Start-End: 105-513
gaataagtctcaggagatctgatgggtttaacaggggtttccgcttttggttcttcctcgttttctctccaccaccatgtaagaagtaccttttgcctcccaccatgattctgaggcctccccagccatgtggaactgaagattctctggcaacagatgatttccttgtagactactttaatgaattcctaagccttccatgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgtaattatgaaaaagttctatgtatcacttggtgaggcttcctatactcaaacaaaagattggtttgcattagcaaaacaaagtcagcaaacag

SEQ ID NO: 174791 - DNA, 4033 bp, Homo sapiens
  Payload ID: 14329
  Gene Symbol: RGS22
  Gene Name: regulator of G-protein signaling 22
  ENST ID: ENST00000523287
  CDS Start-End: 591-3842
attagtgaccaggcaggattccagaggcctttccttcccacttccaccttgaattccaacttaaaatgcaagccatgtacagagaatgaacagagggccagaaatgtgctacgtttgcctgtgtataacgtagggctaggtgctgtctcccatgatttcatttactcaaaggaaatcagatttgagggagataatgtaatattttgtcttgtttcagagccaccaactattacagaagaagaatttgaagattctctggcaacagatgatttccttgtagactactttaatgaattcctaagccttccactaggtctctggacccattatggaaattagattgacacaccaaagctcctgctccctttccaagaacaagcctgagcaacaccacaggatattcaaggagttcttgtttgaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatggcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagcatggatcttatgtgctggacagacattgagcagttccggagaataacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtc

SEQ ID NO: 174792 - DNA, 456 bp, Homo sapiens
  Payload ID: 14329
  Gene Symbol: RGS22
  Gene Name: regulator of G-protein signaling 22
  ENST ID: ENST00000517843
  CDS Start-End: 1-336
aaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggaattctttaaaccagattctgctgacatgagaagctccagtgatttgtttttttgaaggtctgtatcagagcaagcctaacatctaaataaagtttgattctggattttccaggtgggaaataaataaag

SEQ ID NO: 174793 - DNA, 750 bp, Homo sapiens
  Payload ID: 14329
  Gene Symbol: RGS22
  Gene Name: regulator of G-protein signaling 22
  ENST ID: ENST00000519092
  CDS Start-End: 486-750
agtgaattagtgaccaggcaggattccagaggcctttccttcccacttccaccttgaattccaacttaaaatgcaagccatgtacagagaatgaacagagggccagaaatgtgctacgtttgcctgtgtataacgtagggctaggtgctgtctcccatgatttcatttactcaaaggaaatcagatttgagggagataatgtaatattttgtcttgtttcagagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagata

SEQ ID NO: 174794 - DNA, 4253 bp, Homo sapiens
  Payload ID: 14329
  Gene Symbol: RGS22
  Gene Name: regulator of G-protein signaling 22
  ENST ID: ENST00000617334
  CDS Start-End: 196-3951
ccggcctcggcctccctgggcggccgtattgtctaagctccatagcaaccccggcgcggcgccggccacgctagccagcgtagctccggagcccgcgcgccgtcgccgcgtcgctcaggccctgacccgcgctggacccgcgcgctagggccctgacggcccgcgcgggctccaggcgcgggcagcggggacggcatgcccgagaagaggctcaccgcggagccaccaactattacagaagaagaatttgaagattctctggcaacagatgatttccttgtagactactttaatgaattcctaagccttccaaccttttcagaggcaattagatttaatgcagattatggagtttttgaagtagctaatgatgctccacaatttctggaaaaacaactgaaaaaaattctacaaaaccagcaacctcgaaatcccatttatgatgttgtaaggaaaggaaagaatgaggttaaacctgttcaaatgaatgcccccgatgaagatgagaccattaatgtcaactacaatattatgtgtctcagtcgtgaagaaggtattaagtggatcaaaaaagaaagacttccagcatttctggaaagtgattgttactttgaatacaggttagccaaattggtctcacaagtaagatggagcaagtccggcatgaatttcacagtaggatcaaatttttctccctggatcgtgaaaaaaccacccagtctaccacctcctgccactgaagaagataatcttgcttcctatactcaaacaaaagattggtttgcattagcaaaacaaagtcagcaaacagtatcaaccttttcgttaccctgttgtgtaccctacaacaaacttaaatcaccagctatttcatctgtttctgagaattttatctttgatgatggagttcaccctaggacaaaaaaggacccatctaaaaccaacaaattgatttctgaatttgaagaagaagaaggagaagaagaagaggtgtctgtatctctacaagacactccttctcaagctcttctgagagtataccttgaaaagaaacaggatgttgatgaaagcctgacaatgcatttctcaacatgtgaagaatttttaagctcctatatatactttattttgagaggagcaattcagcaaattgttggaaagccagttggagaaaccccagactatataaacttcaacaatataacaaaagtgtcatttgatgattgttttgagtctattcatggcaagaattttttaagtgaattagttcaaactacaaaggagaggtcagaagagatagaacaaacaagtttaagttcaaagaatgagagcgctggaccagagagcagggcggactggtgtatttctcataggacttatgacattggcaatagaaaggagtttgaaagatttaagaaatttataaaaggtacattgggagagagatattggtggctatggatggatattgagaggttaaaagttcttaaggatcctggaagacatcaaagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattgggcaccaagattctgtgttactcattcagcctcaacaaaatatgctagtgctgaactgaaattctggcacctccgtcaagcaaaaccaaggaaggatattgacccttttccacaaatggcaaccctcttgccattaagacccaaatcttgcattccacagatacctgagatccagaaagaagaattcagcttatcacaacctcctaaatctcccaataaatcacctgaagtaaaaacagcaactcaaaagccttggaagcgggagcttttgtatccaggttcttctaaggatgatgtgattgagaaagggtcaaagtacatgtcagaaagcagcaaagtcattcatttaacatcttttactgacatttctgaatgtctcaagccccagctggatagaagatacgcttatacagaagaacctagggttaaaaccgtgtcagatgttggtgccttgggaggatctgacatggaaaatttgttgcaatctttgtatgtagaaaatagagctggattcttctttactaaattctgcgagcattcagggaacaagttgtggaagaacagtgtgtacttttggtttgacctgcaggcttatcatcagcttttctaccaagaaacacttcagccttttaaagtatgcaagcaagcgcaatatctttttgccacatacgttgctccttctgccactcttgacattggactccaacaggaaaagaaaaaagaaatttatatgaaaatacagccaccatttgaagacctttttgacacagcagaggaatatatccttctcctccttcttgagccatggacaaagatggtaaaatcggaccaaattgcttataaaaaggtggagctggtggaagaaactcgacagttagactccacatacttcagaaagctacaggctttgcataaagagacattttccaagaaagctgaggacaccacttgtgaaattggaactggcattttatcactctctaacgtctctaaacgaacagaatattgggataatgttcctgcagaatacaagcattttaagtttagtgatctgcttaacaacaaactggagtttgaacatttccgtcagtttcttgagactcattcttcaagatggatcttatgtgctggacagacattgagcagttccggagaaacttacagagatcgaaatcaaaggaaggcaaaatctatatacattaaaaacaaataccttaataaaaaatatttctttggacccaacagtccagcttctctgtatcagcagaaccaggtaatgcatttaagtggtggctgggggaagattcttcatgagcagcttgatgcacctgttctagttgaaatccagaagcatgtgcaaaataggctagaaaatgtatggctgccattgtttcttgcaagtgaacagtttgcagcacgtcagaagataaaggtacagatgaaagacatagcagaagagctcttactacagaaggctgaaaagaaaatcggggtctggaagcctgtggagagtaagtggatctcttcatcttgtaaaatcattgcttttcgcaaagcattattgaatccagttacttcaagacaatttcaacgttttgtggctctaaaaggagatttattggaaaatggtttactcttttggcaagaagtacaaaaatataaggacttgtgccattctcattgtgatgagtctgtcatccagaagaagattacaactattatcaactgctttattaattccagtattccaccagctttacaaattgacattccagtagagcaagcccagaagattattgaacaccggaaggagttaggaccatatgtatttagagaggcacagatgacaatttttggggttctgtttaaattctggcctcagttctgtgagtttaggaagaatttaacagatgaaaatattatgagtgttttagagagaagacaagaatataataagcagaaaaaaaaattggcagtcctagaagacgaaaaatctggaaaggatggaatcaaacaatatgcaaatacttcagtgcctgctatcaaaactgctttactcagtgattccttcctaggcctccaaccatatggccgacagccaacctggtgctactcaaagtatatagaagccttagaacaggagagaattcttcttaagatccaagaagaactagaaaaaaagttgtttgcaggcttgcaacctctcacaaattttaaggctagctcttcaactatgtctttgaaaaagaatatgtctgcccacagcagccagaagtgacagcattcttgtgaatgtttacatcctgctgctgataggttcaaggaattctttaaaccagattctgctgacatgagaagctccagtgatttgtttttttgaaggtctgtatcagagcaagcctaacatctaaataaagtttgattctggattttccaggtgggaaataaataaagaaaatttggcttgtcttactctcgcagttttaaaattatagctattctgtacacatgacatacaagactataagaactgtttaacttatttagaataaaacaactactatctaggtttgaagaacc

SEQ ID NO: 174795 - DNA, 4387 bp, Homo sapiens
  Payload ID: 14330
  Gene Symbol: RGS3
  Gene Name: regulator of G-protein signaling 3
  Uniprot ID: P49796
  ENST ID: ENST00000350696
  CDS Start-End: 1-3597
atgcctgtaatcccagcactttgggaggttgagatgggcagatcgcaaggtcaggagatcgagaccatcctggctaacaggtcacattcagacagcacacctttgcccaattttctttctggatctcaccgtcctgagtgttgtacctgcaggttgctcacagcctctggagcccaagatagtctcccctttgggaggaggctctacagtggtccctggcgaagttgtgaagaggtctgccacgtctctgtgctcagtgtcctctctacatcctgtggcttgagcctgagcttgcccatattccctggctggatggagtggctaagccctgatatcgctctgcccagaagagatgagtggactcaaacttctccagccaggaagaggatcacgcatgccaaagtccagggtgcaggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctt

SEQ ID NO: 174796 - DNA, 2542 bp, Homo sapiens
  Payload ID: 14330
  Gene Symbol: RGS3
  Gene Name: regulator of G-protein signaling 3
  Uniprot ID: P49796
  ENST ID: ENST00000317613
  CDS Start-End: 72-1880
ctccggttactggggagcaacacagccgcctcgggttgcagacgctcctgtccgggtcgcagtgggacgccatggagcgctccctgcaccgcgtctccctcgggagccggcgtgcccacccggacttgtccttctacctcaccacctttggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcatgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagaggg

SEQ ID NO: 174797 - DNA, 3689 bp, Homo sapiens
  Payload ID: 14330
  Gene Symbol: RGS3
  Gene Name: regulator of G-protein signaling 3
  Uniprot ID: P49796
  ENST ID: ENST00000343817
  CDS Start-End: 151-2904
ttggggaggtgagaggtgatttcctgccattcttctgtggggcgggcttcccagggtgctcatgccaggctgacgggtccagtgcgggctcccgctgctgggggagagctgggttttcatggggcggcagccgaggcaggacccgcagccatgaaccgcttcaatgggctctgcaaggtgtgctcggagcgccgctaccgccagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 174798 - DNA, 1714 bp, Homo sapiens
  Payload ID: 14330
  Gene Symbol: RGS3
  Gene Name: regulator of G-protein signaling 3
  ENST ID: ENST00000342620
  CDS Start-End: 418-924
cttgcagggagcggctgccagcaggccggctggaggcggctttgcgctgccccagcctgggagccctcaggatgtgtgtggggtggagcctgctagggatcccagtgccagggggtgccgttgtgagggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacaggagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctt

SEQ ID NO: 174799 - DNA, 2862 bp, Homo sapiens
  Payload ID: 14330
  Gene Symbol: RGS3
  Gene Name: regulator of G-protein signaling 3
  Uniprot ID: P49796
  ENST ID: ENST00000374134
  CDS Start-End: 518-2077
ttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 174800 - DNA, 2092 bp, Homo sapiens
  Payload ID: 14330
  Gene Symbol: RGS3
  Gene Name: regulator of G-protein signaling 3
  ENST ID: ENST00000374136
  CDS Start-End: 406-1428
agtgctcaagttgtctgggctgagatagggacactgaggggctggctagctcctttgtgcctccagttcccttggagaggagggtggctcttggcaggggtgggctgtgggcttcctgaccttggggtagaggcaagagcctccagcttctggcagtgaccgggcagggctgtgtcctagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcatgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagagggaa

SEQ ID NO: 174801 - DNA, 4591 bp, Homo sapiens
  Payload ID: 14330
  Gene Symbol: RGS3
  Gene Name: regulator of G-protein signaling 3
  Uniprot ID: P49796
  ENST ID: ENST00000374140
  CDS Start-End: 210-3806
aactttggctcagcctgtcttcatccactgtatcctgacacctctcctactccttctctttaatgtacagctgagactgggatacccttagactgaaaggaaggacacggctatgtagaaaagaattgactgaaggggaggagtactcgtgaaccccttgcttcagcctcccaatgttctgagagaggaggagccaggcgcagtggctcatgcctgtaatcccagcactttgggaggttgagatgggcagatcgcaaggtcaggagatcgagaccatcctggctaacaggtcacattcagacagcacacctttgcccaattttctttctggatctcaccgtcctgagtgttgtacctgcaggttgctcacagcctctggagcccaagatagtctcccctttgggaggaggctctacagtggtccctggcgaagttgtgaagaggtctgccacgtctctgtgctcagtgtcctctctacatcctgtggcttgagcctgagcttgcccatattccctggctggatggagtggctaagccctgatatcgctctgcccagaagagatgagtggactcaaacttctccagccaggaagaggatcacgcatgccaaagtccagggtgcaggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 174802 - DNA, 2716 bp, Homo sapiens
  Payload ID: 14330
  Gene Symbol: RGS3
  Gene Name: regulator of G-protein signaling 3
  Uniprot ID: P49796
  ENST ID: ENST00000394646
  CDS Start-End: 151-1926
ttggggaggtgagaggtgatttcctgccattcttctgtggggcgggcttcccagggtgctcatgccaggctgacgggtccagtgcgggctcccgctgctgggggagagctgggttttcatggggcggcagccgaggcaggacccgcagccatgaaccgcttcaatgggctctgcaaggtgtgctcggagcgccgctaccgccagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctt

SEQ ID NO: 174803 - DNA, 571 bp, Homo sapiens
  Payload ID: 14330
  Gene Symbol: RGS3
  Gene Name: regulator of G-protein signaling 3
  ENST ID: ENST00000471324
  CDS Start-End: 350-571
actctgtgccactccgtgccaggccctgagggcacccggttgctgcttccttccgtctttccccaaggactatcagaggagctttcgagctttccagcttttccagcatacgctcctgatctgttactcaggcatgctggttatcccatttcatacgtggacaccttgaggcctaaagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccct

SEQ ID NO: 174804 - DNA, 913 bp, Homo sapiens
  Payload ID: 14330
  Gene Symbol: RGS3
  Gene Name: regulator of G-protein signaling 3
  ENST ID: ENST00000467805
  CDS Start-End: 172-913
atgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaat

SEQ ID NO: 174805 - DNA, 641 bp, Homo sapiens
  Payload ID: 14330
  Gene Symbol: RGS3
  Gene Name: regulator of G-protein signaling 3
  ENST ID: ENST00000496113
  CDS Start-End: 1-641
gtggttagacttcctgtcaatgagtgtagctctcacgcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgc

SEQ ID NO: 174806 - DNA, 2759 bp, Homo sapiens
  Payload ID: 14330
  Gene Symbol: RGS3
  Gene Name: regulator of G-protein signaling 3
  Uniprot ID: P49796
  ENST ID: ENST00000462143
  CDS Start-End: 416-1975
atcggctctgtcctgctctccacaggcctctgctgtgttgggagccactgccttcctcccctcccccaacctgtgggcccacagctcgccagctggcccttgaacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttg

SEQ ID NO: 174807 - DNA, 2155 bp, Homo sapiens
  Payload ID: 14330
  Gene Symbol: RGS3
  Gene Name: regulator of G-protein signaling 3
  Uniprot ID: P49796
  ENST ID: ENST00000462403
  CDS Start-End: 435-1370
attaaataattaaactttaaaatggtgtttttgtaagtttataggacttgtacttctgaagttattcaggcttaaaactactaagatgttggggtcctgctgtatattcatgactggatgtcgccaatgcaggtgactgaggctgagaggccggctggcaggagccattctctgggaggtgccctgtacagggggtctagggaaaagaggggcgaacatgagcaagaggcatttaactcctttcttgccagcagtttcacccagtgctgaattctgctgcctccttggggaccggcaaggctaaaaatggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 174808 - DNA, 1503 bp, Homo sapiens
  Payload ID: 14330
  Gene Symbol: RGS3
  Gene Name: regulator of G-protein signaling 3
  ENST ID: ENST00000620489
  CDS Start-End: 149-727
agtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttct

SEQ ID NO: 174809 - DNA, 1726 bp, Homo sapiens
  Payload ID: 14330
  Gene Symbol: RGS3
  Gene Name: regulator of G-protein signaling 3
  Uniprot ID: P49796
  ENST ID: ENST00000613049
  CDS Start-End: 1-936
atggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctt

SEQ ID NO: 174810 - DNA, 930 bp, Homo sapiens
  Payload ID: 14331
  Gene Symbol: RGS4
  Gene Name: regulator of G-protein signaling 4
  Uniprot ID: P49798
  ENST ID: ENST00000367906
  CDS Start-End: 111-674
agatcactcatgtgttcagtgattcaggttctgttgaagataccaaagatattcggttggtcaaaatgacgggcatataaaggcttctcaggtttctgagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaa

SEQ ID NO: 174811 - DNA, 2606 bp, Homo sapiens
  Payload ID: 14331
  Gene Symbol: RGS4
  Gene Name: regulator of G-protein signaling 4
  Uniprot ID: P49798
  ENST ID: ENST00000367908
  CDS Start-End: 125-406
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaat

SEQ ID NO: 174812 - DNA, 3200 bp, Homo sapiens
  Payload ID: 14331
  Gene Symbol: RGS4
  Gene Name: regulator of G-protein signaling 4
  Uniprot ID: P49798
  ENST ID: ENST00000367909
  CDS Start-End: 341-958
gacattgagtacattttttcccatatccctacttttcagaaggattttctctgctcgttcacttaacattgctgatgcgtcagtcttttcttcctcatctctttcaggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 174813 - DNA, 3311 bp, Homo sapiens
  Payload ID: 14331
  Gene Symbol: RGS4
  Gene Name: regulator of G-protein signaling 4
  Uniprot ID: P49798
  ENST ID: ENST00000421743
  CDS Start-End: 161-1069
agtttctgtatgctgccgggcttataactgtctgtcatccagctatttctctccaccttcttgtttgcataacaaccaaggcaacttccgcaaatcactgcgtggagacgatgatcctgccagctcccttttggaaatcgtgaggatcagatcttggaccatgtataatatgatgcttctaatccaaaagaggaaaggcattgggagtcagctcctaagggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 174814 - DNA, 551 bp, Homo sapiens
  Payload ID: 14331
  Gene Symbol: RGS4
  Gene Name: regulator of G-protein signaling 4
  ENST ID: ENST00000528938
  CDS Start-End: 121-551
aaactgaagggtcagaattccagttgtggatgaaggaaatggtgttatgactgcctcaaggttttgtagcaagtcatagggaaccaagaggaatcttgttttcctcagagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaa

SEQ ID NO: 174815 - DNA, 817 bp, Homo sapiens
  Payload ID: 14331
  Gene Symbol: RGS4
  Gene Name: regulator of G-protein signaling 4
  Uniprot ID: P49798
  ENST ID: ENST00000527809
  CDS Start-End: 59-622
aagacgctcagaggattctgacaatatctttaccggagaagaggcaaatgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtggg

SEQ ID NO: 174816 - DNA, 544 bp, Homo sapiens
  Payload ID: 14331
  Gene Symbol: RGS4
  Gene Name: regulator of G-protein signaling 4
  ENST ID: ENST00000531057
  CDS Start-End: 125-466
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaatattgatctgtattaagctccagtgctttatccacattgtagcctaatattcatgctgcctgccatgtgtgagtcacttctacg

SEQ ID NO: 174817 - DNA, 5862 bp, Homo sapiens
  Payload ID: 14332
  Gene Symbol: RGS5
  Gene Name: regulator of G-protein signaling 5
  Uniprot ID: O15539
  ENST ID: ENST00000313961
  CDS Start-End: 279-824
gagtgttgtgataagagcagatgaaagccttatgccacagtagtgcctgtagcagagaaaggattccctcctccacctcagggcccactgctgctgctctccagcctgcagtttcctctaaggctctggattggctggaagagcaacagagggctgggaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataa

SEQ ID NO: 174818 - DNA, 934 bp, Homo sapiens
  Payload ID: 14332
  Gene Symbol: RGS5
  Gene Name: regulator of G-protein signaling 5
  ENST ID: ENST00000367903
  CDS Start-End: 43-648
agaagtgtctgacaaaacaaagaaacaaaacctcagtgaaaaatgtgcgcaagaaacatttcacaggatattctcatcttacagatgcacagtgctcattggcatatcaatggcaaatatgaggaaaagagtaacctgatgttctgggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaagg

SEQ ID NO: 174819 - DNA, 373 bp, Homo sapiens
  Payload ID: 14332
  Gene Symbol: RGS5
  Gene Name: regulator of G-protein signaling 5
  Uniprot ID: O15539
  ENST ID: ENST00000527988
  CDS Start-End: 152-373
atgtgcaaaggacttgcagctttgccccactcatgcctggaaagatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 174820 - DNA, 851 bp, Homo sapiens
  Payload ID: 14332
  Gene Symbol: RGS5
  Gene Name: regulator of G-protein signaling 5
  Uniprot ID: O15539
  ENST ID: ENST00000530507
  CDS Start-End: 69-626
gttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggttggtctctgggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaa

SEQ ID NO: 174821 - DNA, 278 bp, Homo sapiens
  Payload ID: 14332
  Gene Symbol: RGS5
  Gene Name: regulator of G-protein signaling 5
  ENST ID: ENST00000531476
  CDS Start-End: 64-278
caaagactggctctgctgttaagaagttgtacttaaagcggaggagctaagccacctgccaaaatgtgcaaaggacttgcagctttgccccactcatgcctggaaagaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagat

SEQ ID NO: 174822 - DNA, 5812 bp, Homo sapiens
  Payload ID: 14332
  Gene Symbol: RGS5
  Gene Name: regulator of G-protein signaling 5
  Uniprot ID: O15539
  ENST ID: ENST00000618415
  CDS Start-End: 548-769
caggaagtgggagcaccgcggtttcggggaagagaccggggttgagcgtctagcccatctctgcgtgacttccgccagcgtttagagcgttttcggggtccgagttgaagagcaaaaccaagtgaaggaaacttcactaagttcagggtgacaagggaggaagtacagagaaacagagcgcttaaaaagcactgtctggatatcttcagagggaaaaaggagaaagttaactgaattggtgacacttcgggtctctcacagaggaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataacagcc

SEQ ID NO: 174823 - DNA, 5342 bp, Homo sapiens
  Payload ID: 14333
  Gene Symbol: RGS6
  Gene Name: regulator of G-protein signaling 6
  ENST ID: ENST00000343854
  CDS Start-End: 24-1280
agattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 174824 - DNA, 1564 bp, Homo sapiens
  Payload ID: 14333
  Gene Symbol: RGS6
  Gene Name: regulator of G-protein signaling 6
  Uniprot ID: P49758
  ENST ID: ENST00000355512
  CDS Start-End: 1-1383
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaagg

SEQ ID NO: 174825 - DNA, 5400 bp, Homo sapiens
  Payload ID: 14333
  Gene Symbol: RGS6
  Gene Name: regulator of G-protein signaling 6
  ENST ID: ENST00000402788
  CDS Start-End: 25-1338
cagattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 174826 - DNA, 1476 bp, Homo sapiens
  Payload ID: 14333
  Gene Symbol: RGS6
  Gene Name: regulator of G-protein signaling 6
  Uniprot ID: P49758
  ENST ID: ENST00000406236
  CDS Start-End: 1-1428
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatgaaaatgcaaaaaagagcaagcggctccctctgcagaaggtgcacccttg

SEQ ID NO: 174827 - DNA, 1497 bp, Homo sapiens
  Payload ID: 14333
  Gene Symbol: RGS6
  Gene Name: regulator of G-protein signaling 6
  Uniprot ID: P49758
  ENST ID: ENST00000407322
  CDS Start-End: 1-1434
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgcttctcttctagggatgaaaatgcaaaaaagagcaagcggctccctctgcagaaggtgcacccttgatcgcccag

SEQ ID NO: 174828 - DNA, 1497 bp, Homo sapiens
  Payload ID: 14333
  Gene Symbol: RGS6
  Gene Name: regulator of G-protein signaling 6
  Uniprot ID: P49758
  ENST ID: ENST00000404301
  CDS Start-End: 1-1443
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgtgtctgcagcttctcttctagggatgaaaatgcaaaaaagagcaagcggctccctctgcagaaggtgcacccttg

SEQ ID NO: 174829 - DNA, 1828 bp, Homo sapiens
  Payload ID: 14333
  Gene Symbol: RGS6
  Gene Name: regulator of G-protein signaling 6
  ENST ID: ENST00000434263
  CDS Start-End: 32-1651
cgttgcaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaat

SEQ ID NO: 174830 - DNA, 2111 bp, Homo sapiens
  Payload ID: 14333
  Gene Symbol: RGS6
  Gene Name: regulator of G-protein signaling 6
  Uniprot ID: P49758
  ENST ID: ENST00000554474
  CDS Start-End: 179-1576
gttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagaaagtgagcaaggtcgtagaacttccctagaaaagttcactcgcagtgtgtgctgctggcgcagagtcagaatggccgctgcatttcacccccgaggtggcttccttccagcagtggggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaa

SEQ ID NO: 174831 - DNA, 1764 bp, Homo sapiens
  Payload ID: 14333
  Gene Symbol: RGS6
  Gene Name: regulator of G-protein signaling 6
  Uniprot ID: P49758
  ENST ID: ENST00000555571
  CDS Start-End: 346-1764
agccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 174832 - DNA, 2005 bp, Homo sapiens
  Payload ID: 14333
  Gene Symbol: RGS6
  Gene Name: regulator of G-protein signaling 6
  Uniprot ID: P49758
  ENST ID: ENST00000553525
  CDS Start-End: 524-1996
gcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttccta

SEQ ID NO: 174833 - DNA, 1689 bp, Homo sapiens
  Payload ID: 14333
  Gene Symbol: RGS6
  Gene Name: regulator of G-protein signaling 6
  Uniprot ID: P49758
  ENST ID: ENST00000556437
  CDS Start-End: 92-1564
caccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgaggg

SEQ ID NO: 174834 - DNA, 1110 bp, Homo sapiens
  Payload ID: 14333
  Gene Symbol: RGS6
  Gene Name: regulator of G-protein signaling 6
  Uniprot ID: P49758
  ENST ID: ENST00000554782
  CDS Start-End: 66-1106
aaaacactgactatgaaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctgatccc

SEQ ID NO: 174835 - DNA, 5685 bp, Homo sapiens
  Payload ID: 14333
  Gene Symbol: RGS6
  Gene Name: regulator of G-protein signaling 6
  Uniprot ID: P49758
  ENST ID: ENST00000553530
  CDS Start-End: 208-1626
gactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaa

SEQ ID NO: 174836 - DNA, 5453 bp, Homo sapiens
  Payload ID: 14333
  Gene Symbol: RGS6
  Gene Name: regulator of G-protein signaling 6
  ENST ID: ENST00000622468
  CDS Start-End: 24-1391
agattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 174837 - DNA, 1980 bp, Homo sapiens
  Payload ID: 14334
  Gene Symbol: RGS7
  Gene Name: regulator of G-protein signaling 7
  Uniprot ID: P49802
  ENST ID: ENST00000348120
  CDS Start-End: 1-1275
atggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 174838 - DNA, 2118 bp, Homo sapiens
  Payload ID: 14334
  Gene Symbol: RGS7
  Gene Name: regulator of G-protein signaling 7
  ENST ID: ENST00000366562
  CDS Start-End: 177-1412
agatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 174839 - DNA, 2206 bp, Homo sapiens
  Payload ID: 14334
  Gene Symbol: RGS7
  Gene Name: regulator of G-protein signaling 7
  Uniprot ID: P49802
  ENST ID: ENST00000366563
  CDS Start-End: 68-1501
tgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 174840 - DNA, 2295 bp, Homo sapiens
  Payload ID: 14334
  Gene Symbol: RGS7
  Gene Name: regulator of G-protein signaling 7
  Uniprot ID: P49802
  ENST ID: ENST00000366564
  CDS Start-End: 238-1647
gggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 174841 - DNA, 2494 bp, Homo sapiens
  Payload ID: 14334
  Gene Symbol: RGS7
  Gene Name: regulator of G-protein signaling 7
  Uniprot ID: P49802
  ENST ID: ENST00000366565
  CDS Start-End: 383-1846
gtcgcgcgcacgggccgggcgtctcgactcccgcgcgcgctcggctggtcccagtccccgggagaagaagcggaggagggagagagccagcgaggcggcccaggggagcgggcgcgagtggcggctgccggagccgcctgtgcacgggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 174842 - DNA, 1254 bp, Homo sapiens
  Payload ID: 14334
  Gene Symbol: RGS7
  Gene Name: regulator of G-protein signaling 7
  ENST ID: ENST00000401882
  CDS Start-End: 1-1197
atggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaa

SEQ ID NO: 174843 - DNA, 2064 bp, Homo sapiens
  Payload ID: 14334
  Gene Symbol: RGS7
  Gene Name: regulator of G-protein signaling 7
  ENST ID: ENST00000446183
  CDS Start-End: 177-1358
agatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctca

SEQ ID NO: 174844 - DNA, 1686 bp, Homo sapiens
  Payload ID: 14334
  Gene Symbol: RGS7
  Gene Name: regulator of G-protein signaling 7
  ENST ID: ENST00000440928
  CDS Start-End: 1-981
caagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 174845 - DNA, 4160 bp, Homo sapiens
  Payload ID: 14335
  Gene Symbol: RGS7BP
  Gene Name: regulator of G-protein signaling 7 binding protein
  Uniprot ID: Q6MZT1
  ENST ID: ENST00000334025
  CDS Start-End: 327-1100
agccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagatgacagcagccttctgaatctaactccctaccccctggtgagaagacggaagagaaggttctttgggctgtgttgtctcatctcaagctaggtggctcctcctggaaacccactgagaacatctgaaaaaaaatcacaaaacccgaggacctccagacagctgaaccacacagttattggtttttgactatgttttctatgcttccttattacttttatctgcctccccctgcccttttaaatgattttacacttgaaagcagctgccgtcaagaaaaaaaagaacagattcaaaaaccaggctgtttttaaaagggaattttaaagctgacattgtgcatgtctgctccaaaccacgccatgacagatgcaagaattatgatttttaaattatttaaaggttttttaaatgtattatacagaggaaaaatatttcacatataatagtatatctatagctcttgctgatctcatgttaaaatttatcgtatatgaaagaagtctttaaacatagaaatctatttaaaactgaaaaactgtgttcaaaaatccaatctatcaatatcattagaaataatattataagcaaacatataccacctcacctattgctttctctgcactcatttacatttagtcttccattctgtcagaatctaagagcttcaacataaaagtatcttaatttataaagcaacaaaaaccacatatgaaaagtactaaaattttgtaaatacacaataatcctaataccttcgtacaaatgcatatgggcaactaatttctttttgatccaatgatgtctttttcagcttcttggagaatgaagtaatccagttaggaaatggtgtagtaacatatacaattgccctcaaatgtaaaatcaaatattattacattttgttctaattgaaatctgaagcatggtgtctgcacatcagcatagtgttaaatcttatagggcatgctggaattagctcagattataaaaatatttaacattttacattgttaataaagttttttagttaagctaagcttgtctcattttagatgactatgcagataagatttttccaacgtgtacttggtgtcttgtcttatgcttagactcttgaaagcaggacacattaagcaatactatattttagaaaggaggaagccacatgctttgtttttctgctcacagctttgttgtgatcttccttcactaaacttgtaacatggtacaaattttgttataccgtctcctgttcttcctttggcccatttcccagacagaatttcccatgggttgagagatcaagtctttgcactttttttcttgttttccatagtctgaaaaaccttcaagtcagacaggaggcaccagtgtccagtacaatagaaggatgagctagatgccgataagtggtttatccaagacacatctttagtcccaaccctgttctttaccaatacttatgtgcacaggcatttatatgtataccaatatttttacctaaaaactaaatatattaaggccttttgctttagtgaagatgaactactgtaataattattgtattaggttgaattatatgaaatttcctatatgtgactgttttgacctacaaaatggcaatttcttatagttcaccctaatatccaatgtggaaattatacttggaattgtcttctagctcttttgattgaaagtgaaagaattaaagggttggaagagaacgttatacaggtctctatttagatcataccagctggtttttggccttattctttgaatctagagttgtgttccaaggaaccagtaattaatgcatggttataggtatacctggcttcaaaaaaaagaagtagccgtggaaagctatatgagaaaatcacaattttctgaatcaaatatttgtaaaacaatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatgcaaaagttattaactgataagcccaatcttgttcagcacgttcttctaaatgcctgacctaaataacttctgcttggttaacttgtgttcattctcaccttagcctcagtgtgaaagtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaagatctaaagatcctctttcagtagcatatactaaaattaagtttagtgctcaaaaccctggtaacctacactggcccaaggttacagtaggtaattcaccgtctcacattagacaggccaatgcatcccttaggagctgccccactctcctctcacctaccaaaggattttctcaggtgtggttccaagcgataaagttctactgtctcggcttcctgctggtaattcgctttcagattagcaataacactgagctgatctctagggttaagaagagaacattgaactcattttgtcgcatgtacccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattccaccacgaccacattgtttaaaaccacatttctgggttttaaatcagtcagtggctgggcccaaaggcacttttgggtaagataagtgaagaaatgcccacaaggccaaggtgtcacttaaaaaaacaaacaaaaaaaa

SEQ ID NO: 174846 - DNA, 5606 bp, Homo sapiens
  Payload ID: 14336
  Gene Symbol: RGS8
  Gene Name: regulator of G-protein signaling 8
  Uniprot ID: P57771
  ENST ID: ENST00000258302
  CDS Start-End: 91-687
gttcagggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcataggtgttcaaaagcggtggcattgggggtgggaggctgggggtgaggagggaatgaagggccattccaaagtatgacccagctgccggagcttggactctattccatttacccatgtttgtgttttggttagtggtagcgccttgccgctgtcacccttttctgggtcagcaacttgcccttcatataatgccttgggtcacctctgctgagagggcagatttgctgtgctaggctaatctgtaaataatgcaaatgcaattcccaccacctccacaccctcctcggttaggattcctgactctccacttgttgtaaatccctgggaggaatagctgaaagacttgggctcaactctgtgatttgtagtggccagctctgctcactgggatctcacagcttaggagagaggtttctgtggaattccaggtttctagttctgtcattgacaggtgacctctcagagaaggagtgaaatccatggagttgtttgtttcttccatttccattggaccagtgtgaaaaactgtgattacttcccatcttggcctaggaaattcacaagactaccctaaccttacatttccagaaagagtcttgggtgatgttcttcatgacttctgaagtggaactgccattaagaaagatacagcttgcaaatcttcctcaattctacgaagaacttttccagaagtcaagagacgagggcaagtagcaccagtagacttctattcaaaggggtaccatgtaacctgtctgttgctcagtgtcttctctgccctcacctctctgcagcatcatacatcactgatgtcttaggatgacagcttggcaaagggaggtgaattcctatagcatggagtgctcccatggtgcctaatactttccctgtatctccacctccccccttccatgccggtcatgtaattatgatgggggagaatgggaatttaggctgaaactctttccagcatacttcctgggaaaatgctttcttagaaagatctctctcttggatactatgaagcaccttctttcttgatctttgaccttttggaattgagcatgaaataggaggtgtggctaagaagatcactgtgaacatctggacgtggacaaccttcctaaaatgctttcatggtaccctgcagctgctcttggaaatgtgtcaggcaattcttccttggaggatgagtgagcagcctggaacctactctagccacccaggaaaaagctgactttggcacaagactagtgcccaggagatgaacctttagcagagagaccggaaagtgaaagaggggcatgtaagaggctggtttccaggtggagaggataacagagtggagttactattggaataattcacgaccagtggatttggattcattgcagatctacaaaacgttcagcttgactaagtggaacagcacatgattaggcataagctctggagtgcagatgattgagaactgggctgaaccattttccttttaaggggtgaggggccttttaacgttatgctggtggcgttctagtgcttgtgttcctctccagtaactttgagaatctcttccttttttagctatagctagaccaggccaagaaagcccttgagtcccactagtgctagggccactgcactgctacagcacattgttatctgtgagtgagggtgggtgtgactgtgtgaacctcaaggggagagaagaacacatgtctcctagccctcacagacaccgaaaagacctgtggaattttgtgtttgagaactccaaagcctcaaatgggtgttcctagttagatcaggtagtatcctcccaaccgtggttaaaaaaacaaatcattctttcttagataaagctgccagaattaatttaatgattaaattctctaacagggtattttaaacattgtttacatatgaaatgtgcatctgctgccaactctactgtcgaatatgaggtgcatataaattagaactgcacagagttatagaaatgtgaaacattctgaaaggggatttttctccacttccactattccaaggagaaaagcctgaacaagagtgtcgtgcgatggcctcatagagaggcctagagttcttgccaactattgaggaaacgaaggctgcagatggtggtgtcatggcgccctggtgacttcctcccacaatggggaggtgtgaaagaccaagcttggggatcctgaattttgcagctaagcaagggtatgtgggcatgtgtccatgtgtagaggaacgtgatagctaaatttatggtactcctgtggagtgtctctgtgtgtttgtgtgtgtgtgacaactgtgagcattagactagtacacggcagacatgatcttcccgtggggtggagctttcctcataccttgtatgccctgcttcccacaagaggcacagagctctccactctgatgcctactttcaggcactctggtcgtgccaacccagattttggtctgtgatgaaacaaagagaaatgtttacaacatctagagcaatatccaagcatacctcatccctgagcttccatgtttcccagtcctgccctctctcccattgcctcttccgcaagcccatgtccttgggtatcacttccatttatttcctgtcttccttggctcctcaagccgagcctgtgctgtggacttgccttctggacttgaggcttgctcagtcctgggcctatgcaggctccaggcaagccagggcagggcaagtccaggcaagtctaggcagagctgtgacttctagaattgctctccatccctgagtgatcttgccccactggagggctaacttgtttgggggctggtgtgagattcgtcattgcccttggcaaactaaatagaatactgtcagtatcaaccattcatggccttgggcacctctggggtgaggaagaatcctctgaggcagtccttctcattaaacttgagcatgcacaggaatcacctggaaagcctgtgacacgtgctaattcccaggtgcacacccagagatgctgatctgatagacctgagatggggcccagaaatccacatttttaataagttcctagatggctagtggcctgtggacttggactcttagacagagtctcacgaccttggctgctccttagaatcacctagggagtttttaaaacccagatgtccaggtcccaccccagaacagccaaatcagaagcttttgttagagacccaggcatcagtcatttttaaagctccacaggtgattccaatgtgcagctgaacttaggaagcattgagtctaaggagtgaggaggaacacagcgcgggggcgggggggctgggggaggggggagacacagctgtgtgggccaagggggctggtgtatctccacatgcaagcacgtagataccgaggaacctggccagccctgcagcctgactcgggatggctgcctctatgccctctgcgtctgactttctcctttgagataaaggtgttttggcccaagctgagtgcattgctgggcagcggccatgccgaaggtggtagctgaagggacccttgatcgaaagacgctctgccatgctttctgagtcctgtctcctccaagcttgtctcctagactgtttcccctgtctgttttcctgcgcccttgtgtttggccatttttgcattaggctgtgtctctgtacccaaggccacgtgacaaggtagttggaacccccactcaagtggtgagtgaagagcgtcgtggtaataataatagtagtaacacaacttccaaatttctcagtggagagtgtcacgtcctgggggtatcaagatctgtgaggcctttccaagccctcaccattccctctttggtcccacgttgggtgggcagctgggaaggtcctagttgattttaatctccggtgctttccccagaactgctgctctgaataaaccaaagctgtgaaagagtgttctgcgcaggctgcgggcccagcctctgggtgcaggccctgggcacttgagctgagcagctcagctggctctgctgtgagggaaagccgtgaacttaactgtgctgagagctgggtgagggcaaaatggggaagactgaagaagaaggagcaggtgggagagaccagccgctaacatggtgtctacttctccgtggatcagagaagggatgagtagcaaatgcagaggcagggtggtctcccagcaacaaggatgtccagagttctcctgaccctgtctgcacccacttccatgcaaggcagaggcatcacagttttccatcccaggccacccttcactcttccaagtgtcaggcctctttaaatctgcatccctttgggttagaagcaagagaggtggcaaagtctccctggcactgagagcctgtcccaccatgccactcggcatgagatggtggaggaagaagccaagagcagggatgccttcctgtccccgtggcctctcaggactccacaagatgctgtggaccaagatgagagatttcaggatggggccactggccttcctaggttgggctctgggtcctttcaataaactgttcctttcctgattcttactcccttctggtccttccactcccttccctctgccaggtatggaaaaggtggctgggctcggtgtgcgctccaaccccggtagcattagctgagtcacgcggcgagcacacaacagatttgtagcagctcatctgccatataaaccgcttggctgatggagtcctcattgagttttttcattatcgtgtaaagtggaatcatgtcattcacctttactataaacaaggctgtgagaacataataaacagaacctgaacaagc

SEQ ID NO: 174847 - DNA, 843 bp, Homo sapiens
  Payload ID: 14336
  Gene Symbol: RGS8
  Gene Name: regulator of G-protein signaling 8
  Uniprot ID: P57771
  ENST ID: ENST00000367556
  CDS Start-End: 301-843
gggaggtgtgttgtgcatgcctgtgtgtgtatatgtgtgtgtgtgcccctatgtgttcatgcacacatgcccttcactcgccgaggatttgactgctaaaagaaagatctactttttccccagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttag

SEQ ID NO: 174848 - DNA, 859 bp, Homo sapiens
  Payload ID: 14336
  Gene Symbol: RGS8
  Gene Name: regulator of G-protein signaling 8
  Uniprot ID: P57771
  ENST ID: ENST00000367557
  CDS Start-End: 268-810
ggaccacgcttggagaaccactacactagggcaagcaggaagagagtcctccttctggaactgaagcaggcagtgtgaagacccatgtggaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgct

SEQ ID NO: 174849 - DNA, 1432 bp, Homo sapiens
  Payload ID: 14336
  Gene Symbol: RGS8
  Gene Name: regulator of G-protein signaling 8
  Uniprot ID: P57771
  ENST ID: ENST00000483095
  CDS Start-End: 259-801
gcttcagtatttactggatgtgacaagcagagagaagagctttcagtggggccgcttgctgcctggctcaagtggtgggagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcataggtgttcaaaagcggtggcattgggggtgggaggctgggggtgaggagggaatgaagggccattccaaagtatgacccagctgccggagcttggactctattccatttacccatgtttgtgttttggttagtggtagcgccttgccgctgtcacccttttctgggtcagcaacttgcccttcatataatgccttgggtcacctctgctgagagggcagatttgctgtgctaggctaatctgtaaataatgcaaatgcaattcccaccacctccacaccctcctcggttaggattcctgactctccacttgttgtaaatccctgggaggaatagctgaaagacttgggctcaactctgtgatttgtagtggccagctctgctcactgggatctcacagcttaggagagaggtttctgtggaattccaggtttctagttctgtcattgacaggtgacctctcagagaaggagtgaaatccatggagttgtttgtttcttccatttccattggaccagtgtgaaaaactgtgattacttcccatcttggccta

SEQ ID NO: 174850 - DNA, 563 bp, Homo sapiens
  Payload ID: 14336
  Gene Symbol: RGS8
  Gene Name: regulator of G-protein signaling 8
  ENST ID: ENST00000508450
  CDS Start-End: 393-563
ctttacgctccccactcccggtgcagcagccaaccttcagccagcagcggggctcattagaagagggtcccctggacacttgatttttagctcactggtgactggaaagagttaatacctattctttgctgccccccgcacagcctctgggtgcagagggaggcagctgtgggctgtggggacttctccctgagctgcagccagaggagcttcagaacaccttaacccgaagcctctctgaccatccagttggcaaagaccctcaggccatgaggactggccaaagacagtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattccttt

SEQ ID NO: 174851 - DNA, 2375 bp, Homo sapiens
  Payload ID: 14337
  Gene Symbol: RGS9
  Gene Name: regulator of G-protein signaling 9
  Uniprot ID: O75916
  ENST ID: ENST00000262406
  CDS Start-End: 68-2092
gaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaacttt

SEQ ID NO: 174852 - DNA, 2384 bp, Homo sapiens
  Payload ID: 14337
  Gene Symbol: RGS9
  Gene Name: regulator of G-protein signaling 9
  Uniprot ID: O75916
  ENST ID: ENST00000449996
  CDS Start-End: 73-2088
ctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttggaa

SEQ ID NO: 174853 - DNA, 2078 bp, Homo sapiens
  Payload ID: 14337
  Gene Symbol: RGS9
  Gene Name: regulator of G-protein signaling 9
  ENST ID: ENST00000443584
  CDS Start-End: 94-1980
ggctggggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaagtaagaacccgaaggggacgtgccgtatgcatgggtggctgtgggtgtgcaggcctctgcatgtgaatatgcatgctttgggctggggactgggatgggtga

SEQ ID NO: 174854 - DNA, 2387 bp, Homo sapiens
  Payload ID: 14337
  Gene Symbol: RGS9
  Gene Name: regulator of G-protein signaling 9
  ENST ID: ENST00000584234
  CDS Start-End: 88-1572
ggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaaggcaactccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataa

SEQ ID NO: 174855 - DNA, 2084 bp, Homo sapiens
  Payload ID: 14338
  Gene Symbol: RGSL1
  Gene Name: regulator of G-protein signaling like 1
  ENST ID: ENST00000415960
  CDS Start-End: 1-90
gcccagaaggagatttgcaagatgctcagtccctggtatgatgagtttctagatgaagaggactactggtttctcctttttacgacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaatcaagcgagacccccagcagagataaatcatctcttagaggcctcctaacactgacagaaacttttctggtcaaaaatgaaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctgcaggtcattagccagaataaaggatgtccacattcacaatc

SEQ ID NO: 174856 - DNA, 767 bp, Homo sapiens
  Payload ID: 14338
  Gene Symbol: RGSL1
  Gene Name: regulator of G-protein signaling like 1
  ENST ID: ENST00000437548
  CDS Start-End: 576-767
actaacatcagatgcaacctaggcaagggttctcttatgttctgctctgggaagcatttgaagtatttcagttgtgagtaccactccagccaatgagagaaccagatggagagaaggccatgtgaggaatgggttgaagaattgcctggtgactagccagtggggttggagagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctc

SEQ ID NO: 174857 - DNA, 555 bp, Homo sapiens
  Payload ID: 14338
  Gene Symbol: RGSL1
  Gene Name: regulator of G-protein signaling like 1
  ENST ID: ENST00000447374
  CDS Start-End: 467-555
acactaacatcagatgcaacctaggcaagggttctcttatgttctgctctgggaagcatttgaagtatttcagttgtgagtaccactccagccaatgagagaaccagatggagagaaggccatgtgaggaatgggttgaagaattgcctggtgactagccagtggggttggagagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcac

SEQ ID NO: 174858 - DNA, 731 bp, Homo sapiens
  Payload ID: 14338
  Gene Symbol: RGSL1
  Gene Name: regulator of G-protein signaling like 1
  ENST ID: ENST00000422241
  CDS Start-End: 23-487
gtgtcaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatatgctcagtccctggtatgatgagtttctagatgaagaggactactggtttctcctttttacgagtcaaccaaagatcagcatggtccctgttgttctaaagctaaacctctcaaggaaaaggactcagtgcataagatgactttgacacagaacaggttcatcagctccagacagcataaaagagaatttataggcaaagaagagaacattcttctttataagaggattcagcagtctctagagttaagccaggctttggctgacatgaaggaa

SEQ ID NO: 174859 - DNA, 3676 bp, Homo sapiens
  Payload ID: 14338
  Gene Symbol: RGSL1
  Gene Name: regulator of G-protein signaling like 1
  ENST ID: ENST00000443996
  CDS Start-End: 21-2975
gtcaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaatcaagcgagacccccagcagagataaatcatctcttagaggcctcctaacactgacagaaacttttctggtcaaaaatgaaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctg

SEQ ID NO: 174860 - DNA, 3696 bp, Homo sapiens
  Payload ID: 14338
  Gene Symbol: RGSL1
  Gene Name: regulator of G-protein signaling like 1
  Uniprot ID: A5PLK6
  ENST ID: ENST00000294854
  CDS Start-End: 21-3251
gtcaggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaagagaaggtggttatacaaatgccttccctgaaaatggcttcttcaaaggaaacaagaatcagttccctggaaaaggatatgcattatgcaaaaatatccagcatggagaataaagccaagagccacctccacatggaagccccctttgagacaaaggtctctacccacctgaggactgtcatccccattgtcaatcactcctccaagatgacaattcagaaggccatcaagcaaagcttctccttaggatacatccacttggccttgtgtgctgatgcctgtgcagggaaccctttccgggaccacctgaagaagctgaatttgaaagtggagatccaacttcttgacctctggcaggacttgcagcatttcctcagtgtccttctgaataacaaaaagaatgggaatgcaatctttcgtcacttgctgggtgacagaatctgcgagctctacctgaatgagcagattggtccgtgcttaccactcaaatcccaaaccattcagggcctgaaggaactattgccctctggggatgtgatcccctggattcccaaagcccagaaggagatttgcaagatgctcagtccctggtatgatgagtttctagatgaagaggactactggtttctcctttttacgacacagaacaggttcatcagctccagacagcataaaagagaatttataggcaaagaagagaacattcttctttataagaggattcagcagtctctagagttaagccaggctttggctgacatgaaggaaatggactataggcagtggcgaaagatagctactgaggacctgaagcaaggaggctctctccaggtagagctgacatctccagtgtttctaacagacataactaaaatgtcctttgaggagctttgctacaagaacccaaagatggccatacagaagatcagtgatgactacaaaatatactgtgagaaagcacctaaaatagattttaaaatggaaattatcaaggaaacaaagacagtttcacgctcaaataggaaaatgtccttgctcaaaagaactcttgtaaggaagccatcaatgagacccagaaacttgacagaagtcctcttaaatacacagcacttggagttcttcagggagttcctcaaggaacggaaggctaaaatcccattgcaatttctcacagctgtacagaagatcagtatagagaccaatgaaaagatttgcaagtctctcatagaaaatgtaatcaagactttcttccaaggccaactctctcctgaagaaatgctgcagtgtgatgcccctattatcaaagaaatcgcttccatgcgtcatgtcaccacaagcacactgttaacgctccagggacatgttatgaaatctatagaagaaaagtggtttaaagattatcaagacctgttcccacctcaccatcaggaggtggaagtgcaaagtgaagtacaaatttcgtctaggaagccctcaaagatagtgtcaacttacctacaggaatcccagaagaaaggctggatgagaatgatcagctttatcaggagtttttgcaagtaccgcagatttatgttgaatcctagtaagcgccaggaatttgaagactatcttcaccaggaaatgcaaaatagcaaggaaaatttcaccacagcacacaacacatcgggacgttcagctccaccctccacaaatgtccggagtgcagaccaagagaatggagaaataacccttgtaaagcgtcgtatatttggccacaggattatcactgtcaactttgcgatcaatgatctatatttcttttctgaaatggagaaatttaatgatctggtcagttcagcccacatgctgcaggtcaaccgggcatataatgagaatgatgtgatcctaatgcggtccaaaatgaacattatccaaaaactcttcctgaattctgacatccctccaaagctgagggtgaatgtccctgagttccagaaggatgccatccttgctgccatcacagagggctacctagatcggagcgtcttccatggggctatcatgtctgtcttccccgttgttatgtacttctggaaaaggttttgtttctggaaggcaacccgctcttacttacagtatagggggaagaagttcaaggacagaaaaagccctcctaaatctacggacaagtatcctttctcgagtggaggagacaatgccatcttaaggttcaccttgctcagaggtattgagtggttgcagcctcaacgggaagcaataagttcagttcaaaattcttcatcaagcaaacttactcagccaagactcgtggtatctgccatgcagctgcatcccgtccagggacaaaaattatcctacatcaaaaaagagaagtaatcaagcgagacccccagcagagataaatcatctcttagaggcctcctaacactgacagaaacttttctggtcaaaaatgaaaggtcctggtaccatcttccccagaaacgatcaagaagggcaatgggttgacagcccagatatggcaggaccagactgcaatgggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctg

SEQ ID NO: 174861 - DNA, 708 bp, Homo sapiens
  Payload ID: 14338
  Gene Symbol: RGSL1
  Gene Name: regulator of G-protein signaling like 1
  ENST ID: ENST00000416676
  CDS Start-End: 18-500
aggaagagcatggcaacatgagcagtgctgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggaggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaatgctcagtccctggtatgatgagtttctagatgaagaggactactggtttctcctttttacgagtcaaccaaagatcagcatggtccctgttgttctaaagctaaacctctcaaggaaaaggactcagtgcataagatgactttgacacagaacaggttcatcagctccagacagcataaaagagaatttataggcaaagaagagaacattcttctttataagagga

SEQ ID NO: 174862 - DNA, 481 bp, Homo sapiens
  Payload ID: 14338
  Gene Symbol: RGSL1
  Gene Name: regulator of G-protein signaling like 1
  ENST ID: ENST00000634758
  CDS Start-End: 238-481
ggactaggttgctctcacacttgagaaattcatggataacctccttgccagggaaaaggagacatttcatttccaagttatggtggcatcgcaattacaccattattgcatggactgaagtgcaagtggaggacaaggggttgggagaggaagtggctttggcaaattgagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattgg

SEQ ID NO: 174863 - DNA, 551 bp, Homo sapiens
  Payload ID: 14338
  Gene Symbol: RGSL1
  Gene Name: regulator of G-protein signaling like 1
  ENST ID: ENST00000635407
  CDS Start-End: 9-149
atggcaacatgagcagtgctgagataattggttctacaaatcttataattctgctagaggatgaagtctttgccgattttttcaacacatttctttccctcccgctttgttttgcaggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagaagccagagtgagcctcttaaaaagtaattggtggtggtgctggagggactcccaggaagatgatgaaataggaagcactaggaatctgtttcctcatctagacaacaattgtactggcagaatctgtatgatccaagatgatgagatggaaaaaggcagaccagtggctactccagaaatgcattggcggggtcagagggatgtggcgcttctattcctacctcacag

SEQ ID NO: 174864 - DNA, 532 bp, Homo sapiens
  Payload ID: 14338
  Gene Symbol: RGSL1
  Gene Name: regulator of G-protein signaling like 1
  ENST ID: ENST00000634626
  CDS Start-End: 438-532
aaaatgagccatcatggtagaaaatcaggtccctcatccaattttcagccctgagtcagacctagaagctctgaaatttaaaaaaaaaaaaaaaagcattttaccagttaggaagaatcttgtaatattttgcaagtatttacgagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcag

SEQ ID NO: 174865 - DNA, 723 bp, Homo sapiens
  Payload ID: 14338
  Gene Symbol: RGSL1
  Gene Name: regulator of G-protein signaling like 1
  ENST ID: ENST00000634679
  CDS Start-End: 224-723
actaggttgctctcacacttgagaaattcatggataacctccttgccagggaaaaggagacatttcatttccaagttatggtggcatcgcaattacaccattattgcatggactgaagtgcaagtggaggacaaggggttgggagaggaagtggctttggcaaattggtgaagaattggtggatttctggatccttgctgagaacatcctgagcatagatgagatggacctggaagtgagagactactacctgtccctcctcctcatgctgagggccactcatctgcaggagggctccagggtggtaaccctctgtaacatgaacatcaagtccctcctgaacctctccatctggcatcccaaccaatcaaccactaggagggagatcctgagccacatgcagaaagtggctctgttcaaactccagagctattggcttcccaacttttacacccacaccaagatgaccatggccaaggaggaagcatgccatggtctgatgcaagagtacgagactcgcttatacagcgtttgctacacccacataggagggctccctctgaacatgagcatcaagaagtgccaccactttcagaaacggtactcaagcaggaaagccaagaggaagatgtggcaattggtagatcctgactcttggtctctggaaatggatctcaagccagatgctattggtatgcccctacaggagacatgtcctcaaga

SEQ ID NO: 174866 - DNA, 454 bp, Homo sapiens
  Payload ID: 14338
  Gene Symbol: RGSL1
  Gene Name: regulator of G-protein signaling like 1
  ENST ID: ENST00000634801
  CDS Start-End: 1-173
taaggttcaccttgctcagaggtattgagtggttgcagcctcaacgggaagcaataagttcagttcaaaattcttcatcaagcaaacttactcagccaagactcgtggtatctgccatgcagctgcatcccgtccaggggaatctcatacagcccattcagactaaagggtgatggaaagaagcagaggaaagcagaaacagcaagagtgactgagacctgctgtcatctatatagaagcctttctgatacatgtcagagagtgacatgaagtctcccctctttatacacacgtatgaaaatacatctatccctcattttgagagcctccaactgatccaagtgtcatccggaggaggaggtggcccgtatgtgcaggacctcagggtgccagccctcacccatacacctccagggctgcaggtcattagccagaataaaggatgtccacattc

SEQ ID NO: 174867 - DNA, 577 bp, Homo sapiens
  Payload ID: 14338
  Gene Symbol: RGSL1
  Gene Name: regulator of G-protein signaling like 1
  ENST ID: ENST00000634723
  CDS Start-End: 465-577
agcctaaaatgagccatcatggtagaaaatcaggtccctcatccaattttcagccctgagtcagacctagaagctctgaaatttaaaaaaaaaaaaaaaagcattttaccagttaggaagaatcttgtaatattttgcaagtatttacgaaagtacagcactttttcaaatagataattggttctacaaatcttataattctgctagaggatgaagtctttgccgattttttcaacacatttctttccctcccggtttttggtcagacaccattttatactgttgaaaattcacagtggagcttgtggccagaaataccttgtaacttgattgccaaatacaaagggttattgacctggttggaaaaatgccgattacctttcttctgtaaaacaaacttgtgtttccattacattctctgtcaggagttcatcagtttcattaagtccccagaaggagccaagatgatgagatggaaaaaggcagaccagtggctactccagaaatgcattggcggggtcagagggatgtggcgcttctattcctacctcacaggcagtgcaggtgaagaattggt

SEQ ID NO: 174868 - DNA, 3063 bp, Homo sapiens
  Payload ID: 14339
  Gene Symbol: RMDN1
  Gene Name: regulator of microtubule dynamics 1
  Uniprot ID: Q96DB5
  ENST ID: ENST00000406452
  CDS Start-End: 161-1105
aaaccatgggggcggaagaggtgctgggcaggaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagacagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgc

SEQ ID NO: 174869 - DNA, 1106 bp, Homo sapiens
  Payload ID: 14339
  Gene Symbol: RMDN1
  Gene Name: regulator of microtubule dynamics 1
  Uniprot ID: Q96DB5
  ENST ID: ENST00000430676
  CDS Start-End: 56-910
gcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaat

SEQ ID NO: 174870 - DNA, 444 bp, Homo sapiens
  Payload ID: 14339
  Gene Symbol: RMDN1
  Gene Name: regulator of microtubule dynamics 1
  ENST ID: ENST00000519247
  CDS Start-End: 1-392
gaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaagcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaat

SEQ ID NO: 174871 - DNA, 543 bp, Homo sapiens
  Payload ID: 14339
  Gene Symbol: RMDN1
  Gene Name: regulator of microtubule dynamics 1
  ENST ID: ENST00000523370
  CDS Start-End: 120-314
agcccatccgcagggagctgactccgggctgcatgtcagctccttgccagtaggctggcgcttcgaggccattctggaggccagtcgcttactgaaaaggcaaaactgactttaaggtaatgggaaacccaggaactttcaaaagaggccttttactctcagctttgtcgtatttgggttttgaaacttaccaggttatctctcaggctgctgtggttcatgccacagccaaagagtctcgctgtgtcactgagggtagagtgtggaggtgcgatctcagctcactgcaaccactgcctcctgggttcaagtgatcctcccacctcagcctcccaagtagctgggattacaggcatgtgccatgatgcccagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaa

SEQ ID NO: 174872 - DNA, 557 bp, Homo sapiens
  Payload ID: 14339
  Gene Symbol: RMDN1
  Gene Name: regulator of microtubule dynamics 1
  ENST ID: ENST00000520719
  CDS Start-End: 1-498
gaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattct

SEQ ID NO: 174873 - DNA, 1164 bp, Homo sapiens
  Payload ID: 14339
  Gene Symbol: RMDN1
  Gene Name: regulator of microtubule dynamics 1
  Uniprot ID: Q96DB5
  ENST ID: ENST00000519966
  CDS Start-End: 62-877
agccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattg

SEQ ID NO: 174874 - DNA, 602 bp, Homo sapiens
  Payload ID: 14339
  Gene Symbol: RMDN1
  Gene Name: regulator of microtubule dynamics 1
  ENST ID: ENST00000521045
  CDS Start-End: 318-602
aacttaagtggtggcggccccgcgctgcctaaggaatgtggtgaaccgaggaaagaactcggggccactgtgcctggaacgcccggacaggtcccttccattttgcaaacctccactatccttaactggggctgtcagagaaggagtggggtttgcccccacgcgccccagaagctgcctgctacccgcccttcttgtgcgaaatgtaaaacaggacgggaaagaaccttgaccgctgtgaaattattctccctgtaggcgatgacagatacaacagcgcttgaggctgcccctttcagactttgaaaagtgtggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaa

SEQ ID NO: 174875 - DNA, 728 bp, Homo sapiens
  Payload ID: 14339
  Gene Symbol: RMDN1
  Gene Name: regulator of microtubule dynamics 1
  ENST ID: ENST00000519789
  CDS Start-End: 1-676
tttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggtgaagagaaacagaagcagctgaagggccaggaagtgggtctttctagggatgtggcattctgctggatggctttttaaaatgggttttttcctttagggagaccgaataaactgtgttgtgcacctgcat

SEQ ID NO: 174876 - DNA, 810 bp, Homo sapiens
  Payload ID: 14339
  Gene Symbol: RMDN1
  Gene Name: regulator of microtubule dynamics 1
  ENST ID: ENST00000524172
  CDS Start-End: 182-310
agagaaggagtggggtttgcccccacgcgccccagaagctgcctgctacccgcccttcttgtgcgaaatgtaaaacaggacgggaaagaaccttgaccgctgtgaaattattctccctgtaggcgatgacagatacaacagcgcttgaggctgcccctttcagactttgaaaagtgtggtaatgggaaacccaggaactttcaaaagaggccttttactctcagctttgtcgtatttgggttttgaaacttaccaggttatctctcaggctgctgtggttcatgccacagccaaagtgcggcaatattagaacccaaggaaggaaaaactggcaaagttgtcatatgccaagtggccattgcctcctgaaatgaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaaga

SEQ ID NO: 174877 - DNA, 898 bp, Homo sapiens
  Payload ID: 14339
  Gene Symbol: RMDN1
  Gene Name: regulator of microtubule dynamics 1
  ENST ID: ENST00000517710
  CDS Start-End: 1-479
ggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgttt

SEQ ID NO: 174878 - DNA, 950 bp, Homo sapiens
  Payload ID: 14339
  Gene Symbol: RMDN1
  Gene Name: regulator of microtubule dynamics 1
  ENST ID: ENST00000523911
  CDS Start-End: 101-847
gactccgggctgcatgtcagctccttgccagtaggctggcgcttcgaggccattctggaggccagtcgcttactgaaaaggcaaaactgactttaaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggaaagacatacttgaaactacacaacaaaaagcttgctgctttctggctaatgaaagccaaggactatccagcacacacagaggaggataaacaggtgaagagaaacagaagcagctgaagggccaggaagtgggtctttctagggatgtggcattctgctggatggctttttaaaatgggttttttcctttagggagaccgaataaactgtgttgtgcacc

SEQ ID NO: 174879 - DNA, 968 bp, Homo sapiens
  Payload ID: 14339
  Gene Symbol: RMDN1
  Gene Name: regulator of microtubule dynamics 1
  ENST ID: ENST00000522804
  CDS Start-End: 65-391
tttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagagtctcgctgtgtcactgagggtagagtgtggaggtgcgatctcagctcactgcaaccactgcctcctgggttcaagtgatcctcccacctcagcctcccaagtagctgggattacaggcatgtgccatgatgcccagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgaggtactgatgaattattcaaattcatgaattttaaaagtcatatttttctgaatagatttttgttttcattatctattgctgtatatcaaaccacctatgataacagtggagtagagccatgacagtttgttatttctttttttttttttttttgagacggagtttcgctcttgtcatccgg

SEQ ID NO: 174880 - DNA, 557 bp, Homo sapiens
  Payload ID: 14339
  Gene Symbol: RMDN1
  Gene Name: regulator of microtubule dynamics 1
  ENST ID: ENST00000522942
  CDS Start-End: 1-323
agaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggaaataatttagttactatcaccaggtggatgttacgggttgcctgctacaatgcagaattattcctgtttgacacacatggcagatcgagttaacatttctaaaacataaaagtcatgggatgtgtactaaagtggaagagctgagagtctcatctggtcactgtcaagacattttattgttataatgtcctatctggtttttggaaactcttagaaaccccactttataaacttaaatttcaca

SEQ ID NO: 174881 - DNA, 562 bp, Homo sapiens
  Payload ID: 14339
  Gene Symbol: RMDN1
  Gene Name: regulator of microtubule dynamics 1
  ENST ID: ENST00000519639
  CDS Start-End: 1-455
aaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggtgaagagaaacagaagcagctgaagggccaggaagtgggtctttctagggatgtggcattctgctggatggctttttaaaatgggttttttcctttagggagaccgaataaactgtgttgtgcacctgca

SEQ ID NO: 174882 - DNA, 1985 bp, Homo sapiens
  Payload ID: 14340
  Gene Symbol: RMDN2
  Gene Name: regulator of microtubule dynamics 2
  ENST ID: ENST00000234195
  CDS Start-End: 117-1838
cacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaactttgattctgaagaagacacaggcttcactgatataaaatcttcctcagaccattgtggtagctttatttcccgcagaagacgtttctcatcccgtaaactaagtatagtttcctattacaagagtgccattttttttgatcctcaagcaagtggccagaatgtgtttaatctaaatgaaatcgaaatcttttctaaaacttcaagtaatactgatgctaaaaaacatataaccatctctgctcctgaatataacactaaaaattttaagaattttgaaacaaacactacttctccagcctttgggaacactattgatacagcctcctatcaacaaagcacatcatccttcttttctcttgcaagtgatatttcctctcccgatcaacaaaatggaattgccaatgatattcaacaaaggggccaattatgtaaagatttaaaagatttccttcatcctcgtcctgaaagttacagcacagatcattctccaatcatgattccacagcatccctctcaaagtggaactttcccattcctccataaagctggattttcttcatcttataaaaattctggttgctttatcccacctcaaagcgaattaacttcaggcctgtttgaagatgaagactttgctgtcttgtttcaagatgaagacagatcttcacctattgaaattcctaaaataaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggagctgtagtctggaagataaagagcctttggtaccgcaagccctgtcatctgtgagtgtggcacagtgaaggcctggagagtcatgacctaggccctgtgaagtcaagtatttttaccaagtaaaaagattggcaataaaacatttccacatagt

SEQ ID NO: 174883 - DNA, 1381 bp, Homo sapiens
  Payload ID: 14340
  Gene Symbol: RMDN2
  Gene Name: regulator of microtubule dynamics 2
  Uniprot ID: Q96LZ7
  ENST ID: ENST00000354545
  CDS Start-End: 124-1356
gaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaa

SEQ ID NO: 174884 - DNA, 2280 bp, Homo sapiens
  Payload ID: 14340
  Gene Symbol: RMDN2
  Gene Name: regulator of microtubule dynamics 2
  ENST ID: ENST00000407257
  CDS Start-End: 148-1863
atcacattctgtgttattgccatgttaactccacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaactttgattctgaagaagacacaggcttcactgatataaaatcttcctcagaccattgtggtagctttatttcccgcagaagacgtttctcatcccgtaaactaagtatagtttcctattacaagagtgccattttttttgatcctcaagcaagtggccagaatgtgtttaatctaaatgaaatcgaaatcttttctaaaacttcaagtaatactgatgctaaaaaacatataaccatctctgctcctgaatataacactaaaaattttaagaattttgaaacaaacactacttctccagcctttgggaacactattgatacagcctcctatcaacaaagcacatcatccttcttttctcttgcaagtgatatttcctctcccgatcaacaaaatggaattgccaatgatattcaacaaaggggccaattatgtaaagatttaaaagatttccttcatcctcgtcctgaaagttacagcacagatcattctccaatcatgattccacagcatccctctcaaagtggaactttcccattcctccataaagctggattttcttcatcttataaaaattctggttgctttatcccacctcaaagcgaattaacttcaggcctgtttgaagatgaagactttgctgtcttgtttcaagatgaagacagatcttcacctattgaaattcctaaaataaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagagtgatgtctccatttgtattcttagcaatttttttccaagtagtaaaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaatgaattctcatgaata

SEQ ID NO: 174885 - DNA, 1973 bp, Homo sapiens
  Payload ID: 14340
  Gene Symbol: RMDN2
  Gene Name: regulator of microtubule dynamics 2
  ENST ID: ENST00000402091
  CDS Start-End: 79-1155
acctctacagggcattttatggcttaaggatgacggcctagaagggaagggagagacttactttggattaaatttacaatgggaaagtgcttaagctgctgcaaagaggaccagagcttccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaactttgattctgaagaagacacaggcttcactgatataaaatcttcctcagaccattgtggtagctttatttcccgcagaagacgtttctcatcccgtaaactaagtatagtttcctattacaagagtgccattttttttgatcctcaagcaagtggccagaatgtgtttaatctaaatgaaatcgaaatcttttctaaaacttcaagtaatactgatgctaaaaaacatataaccatctctgctcctgaatataacactaaaaattttaagaattttgaaacaaacactacttctccagcctttgggaacactattgatacagcctcctatcaacaaagcacatcatccttcttttctcttgcaagtgatatttcctctcccgatcaacaaaatggaattgccaatgatattcaacaaaggggccaattatgtaaagatttaaaagatttccttcatcctcgtcctgaaagttacagcacagatcattctccaatcatgattccacagcatccctctcaaagtggaactttcccattcctccataaagctggattttcttcatcttataaaaattctggttgctttatcccacctcaaagcgaattaacttcaggcctgtttgaagatgaagactttgctgtcttgtttcaagatgaagacagatcttcacctattgaaattcctaaaataaggtcacctcagactttaccctctcttagaagggcacctcaaatagttttcccaccagtcactttcatagcctgtagaattcatttctcataactcccctttcctcacaaagcttcactgcattttctgaagaagattcctacattgcagtgtaaatttaattgctgtagttttgaaagttagtttactgatgttattggagtatggaagtcaaagatgattttgtttcaagcttttttcagatttactgcttaaagatgggctaatctcagatttctgagtgactattataatacttttgtggtctgaaaataacatcaagccttgatgtatggactttctaaaagtaatacattctttgagagtttagtatccccttttatcatactctaatcattagaaatagtattcttacataatcattagagctattttcatcaattcacacattttcatatatatcagccttgctagctatatttctcatgcctgatgttccactgacagataatgtttttattaacacaagaatcaaattagaagttaaaaatattatagcggaatatgtagaatatttagaaaccagatattttaactaagtaattttaatacacattcatgtatgtgcaaatctgggcattcaaggaattctgaaatcaggaaaaagtatgtatattagtctcccaaaattttatttttaaaaatgaatatttttcatttttttccgattgtattaacaaagactgttataaagtatttatcaaagtagctaatgaataaaaatgcatgtaagcaattgaaaacatttaagttagaatacaattagattttgtagaggaaaggaatttgcattatttctaattatcctaataaaatgtcccccaaatttatttcatggggctaagatgtta

SEQ ID NO: 174886 - DNA, 1932 bp, Homo sapiens
  Payload ID: 14340
  Gene Symbol: RMDN2
  Gene Name: regulator of microtubule dynamics 2
  Uniprot ID: Q96LZ7
  ENST ID: ENST00000406384
  CDS Start-End: 195-1427
tacttcatcaatttttcttttctttttatggactcttttctgttggcaaaaaaaacctgttatttcttgatcttttggcaccattttcgcacttaataatggcgtaatttctcttctatttgttttctatttgcccatctgttcttttttctccttttcctgccttcttttggaccaaaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaatgaattctcatgaatattttattgtttcaatggagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaatactgttttaccatcaaa

SEQ ID NO: 174887 - DNA, 1426 bp, Homo sapiens
  Payload ID: 14340
  Gene Symbol: RMDN2
  Gene Name: regulator of microtubule dynamics 2
  Uniprot ID: Q96LZ7
  ENST ID: ENST00000417700
  CDS Start-End: 127-924
atgttaactccacatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagaggtaaataaacgaatttactcttcaacaaatcagatgtggtctaccaaaatttaaatgaatcaaagttgtgcttttattatccttcatttttgatgtaagggtattgtgcttagatttgaaggtaaagccatgtttctgcagaatgcattccactagtagcactacaaaattaattatgttatttggagaatctatatactataatgtcaatacataatctataaacatgtatgctttatatttttcttatcaataaactgcagccttaagaatatttctttaaataaaatatttaaatccaataaaatgaattctcatgaatattttattgtttcaatggagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaatactgttttaccatc

SEQ ID NO: 174888 - DNA, 724 bp, Homo sapiens
  Payload ID: 14340
  Gene Symbol: RMDN2
  Gene Name: regulator of microtubule dynamics 2
  ENST ID: ENST00000414644
  CDS Start-End: 198-724
agttacagctttgccaaggtcaatggttgtcactgtccctgagtttctacctttcagataatttttactcatcaaggaatagaaacaaatgtattggaaaggagcaagtgtgacatagtctatgtcctgaacctgaagatcaagtcagtatcagctgccatcttcctcttggaatagactgaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggagggtatattacagctaatactgacacagaagaacagagttttccagtccctaaggcatttaacacacgtgtagagga

SEQ ID NO: 174889 - DNA, 2073 bp, Homo sapiens
  Payload ID: 14340
  Gene Symbol: RMDN2
  Gene Name: regulator of microtubule dynamics 2
  ENST ID: ENST00000440353
  CDS Start-End: 96-578
actgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactgctggaatcagcttgctgctcttgtggtaccacaaggtccgtaaaccagggatagcaatgaagttacctgaatttctttctctgggtaatacatttaattcaataactttgcaagatgaaatacatgatgaccaaggaacaacagtaatctttcaagaaaggcaacttcagatactggagaagttaaacgaattactgacaaatatggaagaactcaaagaggaaatcagatttcttaaagaagctattccaaagctggaggaatatatacaagatgaacttggagggaaaataactgttcataagataagccctcagcacagagcgagaaaaagaagactccccacaattcaaagttcagcaacaagtaatagttcagaggaagcagaaagtgaaggaggggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggtacattttgtgtatccattattttagtgtcagactgattaccatctgcaccaatccctgctgccgttgtcaaggaaatcttttctccatgtggagcctcagtttgaatcctggttttggcatgttctgttttaagcccctcataatgcaagttattaatatgttttaagtctaaactccttagaacaactagttatgccctaggttctaggaattacaaactactttttaaaaataacccagcagcctaaatgaaggtttaggtttgacagctcttactgctaagtccaagaacagctctctgagtcacttgagcatgtgcagaaacagtcacgccctgatggttaaacttagtcccagtcctcctgattagcctaacatagaaccagtttaatcttaaggaaataaaagtgctaaaggaagagttattttaaaagctaactcctaaagttgcagacatttctctggaagattcttggggtatcagaccaaatcagtattctcaatcctgtcttaaaatgtataatcgctgtactatacaactctaagcagtaatatatgtgtgtgtgagctcacatgtaaatgtataatatagccacccatataatcaacttcctgtgggggtaataatccctttacctttctctggaaccagtttcaaaattttatagttactaaatgtgttttccttcccaacctacctacttcaagtttacaaaaatacagacaaggctgcatgcagtggctcacctctgtaatcccaacactttggaaggccgaggtaggaggattgcttgaggccaggagtttgagaccagcctgggcaacatagcaacatgccatctctac

SEQ ID NO: 174890 - DNA, 582 bp, Homo sapiens
  Payload ID: 14340
  Gene Symbol: RMDN2
  Gene Name: regulator of microtubule dynamics 2
  ENST ID: ENST00000425641
  CDS Start-End: 1-451
agttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggataaagaggcacagaaagagatgcaaaaaataatgacttccttgaagagacttcgtaagacaaaataatttcattaatgtggatgaaaaatggaaaactcagcaaaggacatgaacaagttgttggcagaagaggaaaaacaaacaaatgtagtattgtaactggtaatcaaaagatgtgaataaaattacaataaaat

SEQ ID NO: 174891 - DNA, 830 bp, Homo sapiens
  Payload ID: 14340
  Gene Symbol: RMDN2
  Gene Name: regulator of microtubule dynamics 2
  ENST ID: ENST00000442857
  CDS Start-End: 116-830
acatgcagcttgagcattcagtcttctgacctgttccacctctacagggcattttatggcttaaggatgacggcctagaagggaagggagagacttactttggattaaatttacaatgggaaagtgcttaaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttgg

SEQ ID NO: 174892 - DNA, 3138 bp, Homo sapiens
  Payload ID: 14341
  Gene Symbol: RMDN3
  Gene Name: regulator of microtubule dynamics 3
  Uniprot ID: Q96TC7
  ENST ID: ENST00000260385
  CDS Start-End: 1069-2481
tgttatcatagtccataaaatcggtctttttagttgccacaattataagaagttgcatacaattacaagagtaaaacagaattataagacagcacgttaggtttaagatttatggccgggtgcggcggctcacgcactttgggagcccgaggcgggcggatcgcactttgagagaccaggagagcgggacccagtctctacaaaataaaaataaaaataaaatgtggggagagcgtgacgttttccaggtacagaggggaggtccaggcagaagcgcaggtagaaagtgtgaatatgctgagcgtattccgggagcagcaagttaagccggtgtgaccggagggaaatggaggcctggctgccggacggtgagggtgactgcgcgagcgtccgcccaagaagtctccctgccttcccgcctttcccctgtcttgggccccttcttgctttcctttcgcgctctgtgctgactccgcccctccggcggcgcccgtggccccgcccctgagggaaacagacaaggggcggggccggcgcggtcatctctctgcgccttcccgcagggcgccgagcacctggcgccgcctgcctgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgggggttgaaggcccagaagccggactctgtgacccgggtcggggggtgtactggaggggcggctacgtccaggctgggtgagaagagaggcagtggggcccaggaggctggaggaagccttagggttcagactggggtgcacgtagtcgagagctcagggtttgggcaaggggatacctgccggggttcagccttgagggtgggtttaccgggttcacgaatctctctctctccttacccccgcccgcccgcccgcctgcctgctcccggtgacttctgctggccgcaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttatca

SEQ ID NO: 174893 - DNA, 2251 bp, Homo sapiens
  Payload ID: 14341
  Gene Symbol: RMDN3
  Gene Name: regulator of microtubule dynamics 3
  Uniprot ID: Q96TC7
  ENST ID: ENST00000338376
  CDS Start-End: 186-1598
gacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 174894 - DNA, 1008 bp, Homo sapiens
  Payload ID: 14341
  Gene Symbol: RMDN3
  Gene Name: regulator of microtubule dynamics 3
  ENST ID: ENST00000560905
  CDS Start-End: 146-1008
agacaaggggcggggccggcgcggtcatctctctgcgccttcccgcagggcgccgagcacctggcgccgcctgcctgacgtcacggtcactgacagcgtgagcccgcggcggctgctgccatggtggctggcggccgggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtg

SEQ ID NO: 174895 - DNA, 2139 bp, Homo sapiens
  Payload ID: 14341
  Gene Symbol: RMDN3
  Gene Name: regulator of microtubule dynamics 3
  ENST ID: ENST00000558777
  CDS Start-End: 172-522
tgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtt

SEQ ID NO: 174896 - DNA, 1033 bp, Homo sapiens
  Payload ID: 14341
  Gene Symbol: RMDN3
  Gene Name: regulator of microtubule dynamics 3
  ENST ID: ENST00000558232
  CDS Start-End: 1-919
agaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgggtgtgggggaaggccaaggcccccattctccacagttgaggaaaaaggggcctcacccgtttctgtctggtctgcagtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctggg

SEQ ID NO: 174897 - DNA, 931 bp, Homo sapiens
  Payload ID: 14341
  Gene Symbol: RMDN3
  Gene Name: regulator of microtubule dynamics 3
  ENST ID: ENST00000560460
  CDS Start-End: 179-931
cggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgccctttaatgaggagcagtagtaagaggcaccccatggtgagcagaaagacaagctggatgggacctaatggtacccttcgggatggggcctgctttccagatgccacatggaagagaaccagagagtggctcggcggcgaaggtttccgtttgtccgggagaggagtgactccactggctccagctctgtctacttcacggcctcctcgggagccacgttcacagatgctgagagtgaaggggggaaaagaagaagcagaggctgctctggagaagggggatgagagtgctgactgtcacctgtggtatgcggtgctttgtggtcagctggctgagcatgagagcatccagaggcgcatccagagtggcttt

SEQ ID NO: 174898 - DNA, 4676 bp, Homo sapiens
  Payload ID: 14342
  Gene Symbol: RTEL1
  Gene Name: regulator of telomere elongation helicase 1
  Uniprot ID: Q9NZ71
  ENST ID: ENST00000318100
  CDS Start-End: 1218-4208
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaaaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 174899 - DNA, 1339 bp, Homo sapiens
  Payload ID: 14342
  Gene Symbol: RTEL1
  Gene Name: regulator of telomere elongation helicase 1
  ENST ID: ENST00000356810
  CDS Start-End: 271-1339
ctctgagctggctgacagctggggacgggtggcggccctcgactggagtcggttgagttcctgagggaccccggttctggaaggttcgccgcggagacaagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccag

SEQ ID NO: 174900 - DNA, 4623 bp, Homo sapiens
  Payload ID: 14342
  Gene Symbol: RTEL1
  Gene Name: regulator of telomere elongation helicase 1
  Uniprot ID: Q9NZ71
  ENST ID: ENST00000360203
  CDS Start-End: 326-4228
ggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 174901 - DNA, 2273 bp, Homo sapiens
  Payload ID: 14342
  Gene Symbol: RTEL1
  Gene Name: regulator of telomere elongation helicase 1
  Uniprot ID: Q9NZ71
  ENST ID: ENST00000370003
  CDS Start-End: 246-1883
agcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccagga

SEQ ID NO: 174902 - DNA, 4955 bp, Homo sapiens
  Payload ID: 14342
  Gene Symbol: RTEL1
  Gene Name: regulator of telomere elongation helicase 1
  Uniprot ID: Q9NZ71
  ENST ID: ENST00000370018
  CDS Start-End: 828-4487
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 174903 - DNA, 664 bp, Homo sapiens
  Payload ID: 14342
  Gene Symbol: RTEL1
  Gene Name: regulator of telomere elongation helicase 1
  ENST ID: ENST00000425905
  CDS Start-End: 1-664
ttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggc

SEQ ID NO: 174904 - DNA, 4273 bp, Homo sapiens
  Payload ID: 14342
  Gene Symbol: RTEL1
  Gene Name: regulator of telomere elongation helicase 1
  Uniprot ID: Q9NZ71
  ENST ID: ENST00000508582
  CDS Start-End: 347-4078
aacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccatagcttgctacacggacatcccaaagattatttacgcctccaggacccactcgcaactcacacaggtcatcaacgagcttcggaacacctcctaccgctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacagatccacttgtgccgtaagaaggtggcaagtcgctcctgtcatttctacaacaacgtagaagaaaaaagcctggagcaggagctggccagccccatcctggacattgaggacttggtcaagagcggaagcaagcacagggtgtgcccttactacctgtcccggaacctgaagcagcaagccgacatcatattcatgccgtacaattacttgttggatgccaagagccgcagagcacacaacattgacctgaaggggacagtcgtgatctttgacgaagctcacaacgtggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccagggctgaacatggagctggaagacattgcaaagctgaagatgatcctgctgcgcctggagggggccatcgatgctgttgagctgcctggagacgacagcggtgtcaccaagccagggagctacatctttgagctgtttgctgaagcccagatcacgtttcagaccaagggctgcatcctggactcgctggaccagatcatccagcacctggcaggacgtgctggagtgttcaccaacacggccggactgcagaagctggcggacattatccagattgtgttcagtgtggacccctccgagggcagccctggttccccagcagggctgggggccttacagtcctataaggtgcacatccatcctgatgctggtcaccggaggacggctcagcggtctgatgcctggagcaccactgcagccagaaagcgagggaaggtgctgagctactggtgcttcagtcccggccacagcatgcacgagctggtccgccagggcgtccgctccctcatccttaccagcggcacgctggccccggtgtcctcctttgctctggagatgcagatccctttcccagtctgcctggagaacccacacatcatcgacaagcaccagatctgggtgggggtcgtccccagaggccccgatggagcccagttgagctccgcgtttgacagacggttttccgaggagtgcttatcctccctggggaaggctctgggcaacatcgcccgcgtggtgccctatgggctcctgatcttcttcccttcctatcctgtcatggagaagagcctggagttctggcgggcccgcgacttggccaggaagatggaggcgctgaagccgctgtttgtggagcccaggagcaaaggcagcttctccgagaccatcagtgcttactatgcaagggttgccgcccctgggtccaccggcgccaccttcctggcggtctgccggggcaaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccagttcctctctgggcaggagtggtaccggcagcaggcgtccagggctgtgaaccaggccatcgggcgagtgatccggcaccgccaggactacggagctgtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgca

SEQ ID NO: 174905 - DNA, 2222 bp, Homo sapiens
  Payload ID: 14342
  Gene Symbol: RTEL1
  Gene Name: regulator of telomere elongation helicase 1
  ENST ID: ENST00000496816
  CDS Start-End: 1-951
gtcttcctctgtgaccacaggttcgcctttgccgacgcaagagcccaactgccctcctgggtgcgtccccacgtcagggtgtatgacaactttggccatgtcatccgagacgtggcccagttcttccgtgttgccgagcgaactatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggcccacagctgctccaccctgtccctcctgtctgagaagaggccggcagaagaaccgcgaggagggaggaagaagatccggctggtcagccacccggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggcttctaccagtttgtgcggccccaccataagcagcagtttgaggaggtctgtatccagctgacaggacgaggctgtggctatcggcctgagcacagcattccccgaaggcagcgggcacagccggtcctggaccccactgggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacaggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgccca

SEQ ID NO: 174906 - DNA, 6408 bp, Homo sapiens
  Payload ID: 14343
  Gene Symbol: RPTOR
  Gene Name: regulatory associated protein of MTOR, complex 1
  Uniprot ID: Q8N122
  ENST ID: ENST00000306801
  CDS Start-End: 363-4370
gagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgccgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 174907 - DNA, 5734 bp, Homo sapiens
  Payload ID: 14343
  Gene Symbol: RPTOR
  Gene Name: regulatory associated protein of MTOR, complex 1
  Uniprot ID: Q8N122
  ENST ID: ENST00000544334
  CDS Start-End: 163-3696
tcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagcgagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgccgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 174908 - DNA, 2461 bp, Homo sapiens
  Payload ID: 14343
  Gene Symbol: RPTOR
  Gene Name: regulatory associated protein of MTOR, complex 1
  ENST ID: ENST00000574767
  CDS Start-End: 812-1099
aggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctg

SEQ ID NO: 174909 - DNA, 2286 bp, Homo sapiens
  Payload ID: 14343
  Gene Symbol: RPTOR
  Gene Name: regulatory associated protein of MTOR, complex 1
  Uniprot ID: Q8N122
  ENST ID: ENST00000570891
  CDS Start-End: 754-1893
atgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaa

SEQ ID NO: 174910 - DNA, 787 bp, Homo sapiens
  Payload ID: 14343
  Gene Symbol: RPTOR
  Gene Name: regulatory associated protein of MTOR, complex 1
  ENST ID: ENST00000576366
  CDS Start-End: 1-708
gccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcaggtacgggagcccggctgcctggtgatctggacactgagagcgttgcttctcagatgggggctcatggcctcagcctcaggctgctcacatcaccatgggatggggcaggacccaccctgccgtcctgggtctgtgggccactctctgcctttgcagacccgggtgctggtcctcactcgtgcacccctctgcctgcactccttaggagcactgctgggtgtgtcccggtccctctgcctgcactctttaggagcactgctgggtgtgtcccggttctccgcccctggttctggtttcaccattctgggcagcttccatgtaacgaaacaggagcacggagttacctggctctgcccttcctgggcacacagcactctgcgtccgcttgggggcagctgcactgcagagcatttgttctgaatgtgttgtcttttctgtgaacatccaagtacgctgcataaataggtacactctctttgcctttaactaagttgaaaaa

SEQ ID NO: 174911 - DNA, 4332 bp, Homo sapiens
  Payload ID: 14344
  Gene Symbol: RFX1
  Gene Name: regulatory factor X, 1 (influences HLA class II expression)
  Uniprot ID: P22670
  ENST ID: ENST00000254325
  CDS Start-End: 236-3175
cacggtagtcgtggcgaccaagcaacccggcaacgcgagtcaacaacaacaaccgcccggccgacccccacccccaccccccaggcccggcccggggaccccagcacgtcccgtccccttcccaacatcgactccgagacctccgaaaagcgtttccgcagacagaagtggggagaagcggaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagcggctgctggtccagacgagcgtgcaggccaagccaggccacgtgtcgcccctccagctgaccaacatccaagtgccccagcaggctcttcccacgcagcgtctggtggtgcagagcgcagccccaggcagcaaaggtggccaggtctccctgacggtccatggtacccagcaggtgcactcgcccccagagcagtcgccggtgcaggccaacagctcttccagcaagacagccggggcccccacgggcacagtgccacagcagctgcaggtccacggcgtccagcagagtgtccccgtcacccaagagagatctgtggtccaggccactccacaagcgcccaaacccggcccggtgcagccgctgaccgtgcagggcctccagccagtccacgtggctcaagaggtgcagcagctccagcaggtgcccgtcccacacgtgtactccagccaggtgcagtatgtggagggcggcgatgccagctacacggccagtgccatccgttccagcacctactcctatcccgagacgccgctgtacacgcagacggcaagcaccagctactacgaggccgcaggcacggccacccaggtcagcacccccgccacctcccaggcggtggccagcagtggctccatgcccatgtacgtgtccggcagccaggtcgtcgccagctccaccagcactggggctggggccagcaacagcagcggaggtggtggcagtggtggtggcggcggcggcgggggaggcggtggcgggggtggcagtggcagcaccggaggcggcggcagcggagcaggcacctacgtgatccaaggcggctacatgctgggcagtgccagccagtcttactctcacaccacccgtgcctcgccagccacggtccagtggctcctggacaactatgagacggctgagggcgtgagtctgccacggagcaccctctactgccactacttactgcactgccaggagcagaagctggagcccgtcaacgccgcctccttcggcaagctcatccgctccgtcttcatgggcctgcgaacccgccgtctgggcaccaggggcaactccaagtaccactactatggcctgcgcatcaaggccagctcacccctgctgcggctgatggaggaccagcagcacatggccatgcggggccagcccttctcgcagaagcagaggctcaagcccatccagaagatggaaggcatgaccaacggcgtggcggtggggcagcagccgagcacggggctgtcggacatcagcgcccaggtgcagcagtaccagcaatttttggatgcctctcggagcctccctgacttcacagagctcgacctccagggcaaggtgctgcctgagggcgtcgggcccggggacatcaaagccttccaggtcctgtaccgggaacactgtgaggccattgtcgacgtcatggtgaacctgcagttcaccctggtggagacgctgtggaagaccttctggaggtacaacctcagccagcccagtgaggcgccaccgctggctgtacatgacgaggccgagaagcgactgcccaaagccatcctggtgctcctctccaagttcgagcccgtgctccaatggaccaagcactgtgacaacgtgctgtaccagggcctggtggaaatcctcattcccgacgtgctgcggcccatccccagtgccttgacccaagcgatccggaactttgccaagagcctggagagctggctcacccacgccatggtcaacatccccgaggagatgctgcgggtgaaggtggccgcggctggcgccttcgcgcagacactgcggcgctacacgtcgctcaaccacctggcgcaggcggcgcgcgctgtgctgcagaacaccgcacagatcaaccagatgctgagcgacctcaaccgcgtggacttcgccaacgtgcaggagcaggcctcgtgggtgtgccgctgcgaggaccgcgtggtgcagcggctggagcaggacttcaaggtgacgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtccctcaaagcttctgtggcttcgtggtcactgctccagcctcagccagggcagggagggggactccgagacagggaagaccggggccctcctcccttatggggccggcacaatcagtgggctgggcggagccgcagctgcaaactctgacacaaaagacgtgccttaaggaacccgccgcgtgcccaggtgccccgcggggcatccagctcggccccttggccgcccccctcccaggccccagcgtcttctccccagccccgtcctcccaccaccccagggggcaggcaggcaggccccctcccgtgcgaaactgttaacttattcagctcgctggctttgcacagcctgtcctgggcccagccctgagccccgggccggcgcaggtgggcgtcacctggggactccccactgtcagcagcagccccgggacaccctacccccagcaaccccactgcttccccttcttggtattaagtgcaattaaagccgtgggtgtcgcatcttctccagcgctgggccctcccttgcccccaagctcaagaagggggcactgcccggcccggctgtgaggagggcggcagggggcacggcctccagcttccaaagagcagcgagccgcggagccggggagtgcccacagaccccagcccccgcgcccccgccctccgccgctggtttgtaatggaaccttttctgtgcccctatcttcccggagaccacgcttctcctccgtgccgtgcgacccccaccccatgactattgtgcgattcgtgagcgccgcccgagcggagttggtaacttgttgggtttttttccaaccatcatggccttatctgttccagttttctcagtgttttcagcctgtgagatagatgtttatggcaagaaaaaggaaaaaaaaatggaaatctgacctattgtataaaaatcactattttgtgtgctccgcgtgctatagcttttggggcggccctgcccagtccccgtgcccacggggctccctctcccggtggtgaaagtgtccacacgtgtggtagtctagtgtgccgagctgttttctacctttttgtagtctttcttaaaacaataaattccgctgtgata

SEQ ID NO: 174912 - DNA, 886 bp, Homo sapiens
  Payload ID: 14344
  Gene Symbol: RFX1
  Gene Name: regulatory factor X, 1 (influences HLA class II expression)
  ENST ID: ENST00000588885
  CDS Start-End: 413-886
aacccggcaacgcgagtcaacaacaacaaccgcccggccgacccccacccccaccccccaggcccggcccggggaccccagcacgtcccgtccccttcccaacatcgactccgagacctccgaaaagcgtttccgcagacagaagtggggagaagcggagagacggggtttcgccatgttggccagactggtctcgaactcctgacctcagctgatccacctgcctaggcctcacaaagtgctggaattataggtgtgagccaccgtgcccggcctgatctcattggatctttgcagcaatttgatgaattgggtgttctcgttatccccaggtgacaggcaactgaggcccagaagaaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagatgtgcacagcagccgcccgccacccaaccacgccaggcctccct

SEQ ID NO: 174913 - DNA, 3993 bp, Homo sapiens
  Payload ID: 14345
  Gene Symbol: RFX2
  Gene Name: regulatory factor X, 2 (influences HLA class II expression)
  Uniprot ID: P48378
  ENST ID: ENST00000303657
  CDS Start-End: 151-2322
aggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgcctta

SEQ ID NO: 174914 - DNA, 3595 bp, Homo sapiens
  Payload ID: 14345
  Gene Symbol: RFX2
  Gene Name: regulatory factor X, 2 (influences HLA class II expression)
  Uniprot ID: P48378
  ENST ID: ENST00000359161
  CDS Start-End: 106-2277
agacgggaacagcatggtggatggtgtgcaaatgactgatttaaacatttaaaggaaactgtaaatacaagcagcttgtaacagaaaaattccaaagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagta

SEQ ID NO: 174915 - DNA, 589 bp, Homo sapiens
  Payload ID: 14345
  Gene Symbol: RFX2
  Gene Name: regulatory factor X, 2 (influences HLA class II expression)
  ENST ID: ENST00000592883
  CDS Start-End: 162-589
actttgaagaaagacttctcgacgccgagacactgctggtggtactcgatgtaggggtgactggcaaccatgccgtgaagacactcaagcaattctgtggagaaggccatggaatgaggagctgagacttcctgccaacaaccagtcatctagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccc

SEQ ID NO: 174916 - DNA, 337 bp, Homo sapiens
  Payload ID: 14345
  Gene Symbol: RFX2
  Gene Name: regulatory factor X, 2 (influences HLA class II expression)
  ENST ID: ENST00000587321
  CDS Start-End: 239-337
gactgttacttaccaacggggaccaacacgcagcagccgctgccgccgccgcgggagccgctgcccgaactcccggcccgaactccagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcag

SEQ ID NO: 174917 - DNA, 534 bp, Homo sapiens
  Payload ID: 14345
  Gene Symbol: RFX2
  Gene Name: regulatory factor X, 2 (influences HLA class II expression)
  ENST ID: ENST00000587181
  CDS Start-End: 236-534
gttacttaccaacggggaccaacacgcagcagccgctgccgccgccgcgggagccgctgcccgaactcccggcccgaactccaggcggagttagaacattccatttttttatccaaaattatcttttgctcggatttgggaactgacttaatacggagctgggaatggagacaccaaaaacagaaccagacaaagctgagggtttgttctcgcccctcctggacagcacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgta

SEQ ID NO: 174918 - DNA, 538 bp, Homo sapiens
  Payload ID: 14345
  Gene Symbol: RFX2
  Gene Name: regulatory factor X, 2 (influences HLA class II expression)
  ENST ID: ENST00000589340
  CDS Start-End: 1-538
agatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgca

SEQ ID NO: 174919 - DNA, 565 bp, Homo sapiens
  Payload ID: 14345
  Gene Symbol: RFX2
  Gene Name: regulatory factor X, 2 (influences HLA class II expression)
  ENST ID: ENST00000589742
  CDS Start-End: 271-565
accgccgccgccatagagactgtagccgtggagactgttacttaccaacggggaccaacacgcagcagccgctgccgccgccgcgggagccgctgcccgaactcccggcccgaactccagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctcc

SEQ ID NO: 174920 - DNA, 535 bp, Homo sapiens
  Payload ID: 14345
  Gene Symbol: RFX2
  Gene Name: regulatory factor X, 2 (influences HLA class II expression)
  ENST ID: ENST00000593241
  CDS Start-End: 255-535
gccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgt

SEQ ID NO: 174921 - DNA, 2578 bp, Homo sapiens
  Payload ID: 14345
  Gene Symbol: RFX2
  Gene Name: regulatory factor X, 2 (influences HLA class II expression)
  Uniprot ID: P48378
  ENST ID: ENST00000592546
  CDS Start-End: 149-2245
gaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctg

SEQ ID NO: 174922 - DNA, 537 bp, Homo sapiens
  Payload ID: 14345
  Gene Symbol: RFX2
  Gene Name: regulatory factor X, 2 (influences HLA class II expression)
  ENST ID: ENST00000586806
  CDS Start-End: 97-537
gagactgttacttaccaacggggaccaacacgcagcagccgctgccgccgccgcgggagccgctgcccgaactcccggcccgaactccagcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccg

SEQ ID NO: 174923 - DNA, 569 bp, Homo sapiens
  Payload ID: 14345
  Gene Symbol: RFX2
  Gene Name: regulatory factor X, 2 (influences HLA class II expression)
  ENST ID: ENST00000586302
  CDS Start-End: 63-569
agccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccat

SEQ ID NO: 174924 - DNA, 577 bp, Homo sapiens
  Payload ID: 14345
  Gene Symbol: RFX2
  Gene Name: regulatory factor X, 2 (influences HLA class II expression)
  ENST ID: ENST00000592473
  CDS Start-End: 246-577
attttcctttgttcctcgttactccaacgttgcctcaaatgtcagctccttagagagacccagggtgaccaactcttcccgctttggggatttcccggttttagcactgaaattcccatatcctgggaaaccccttagtcttgggccaagcaggattgttggatatcccagggagatcatctctggctgctctatctaagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggg

SEQ ID NO: 174925 - DNA, 446 bp, Homo sapiens
  Payload ID: 14345
  Gene Symbol: RFX2
  Gene Name: regulatory factor X, 2 (influences HLA class II expression)
  ENST ID: ENST00000592281
  CDS Start-End: 131-446
acggccgtagtccagggctgcttctagctgcgtctctcctgtgccccctcacatgaagtcaggaagccacgggagatgttcccactggcgcgtttgactcagcagtggctccaaaaggtcaaacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacgg

SEQ ID NO: 174926 - DNA, 1522 bp, Homo sapiens
  Payload ID: 14346
  Gene Symbol: RFX3
  Gene Name: regulatory factor X, 3 (influences HLA class II expression)
  Uniprot ID: P48380
  ENST ID: ENST00000302303
  CDS Start-End: 248-1489
actctactactcaataatagttttgttatgtaggaagatgcagcagcttgtttgtgtgaacttctgcttccactacaaacagtactttaaagacaggccttccactgccattcagaaagcagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgaggtcagaatcaacatcttttccaattcattttcatggctgagtagatgtcacaactaataaattagagatatgt

SEQ ID NO: 174927 - DNA, 2971 bp, Homo sapiens
  Payload ID: 14346
  Gene Symbol: RFX3
  Gene Name: regulatory factor X, 3 (influences HLA class II expression)
  Uniprot ID: P48380
  ENST ID: ENST00000358730
  CDS Start-End: 9-2132
agaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacaga

SEQ ID NO: 174928 - DNA, 364 bp, Homo sapiens
  Payload ID: 14346
  Gene Symbol: RFX3
  Gene Name: regulatory factor X, 3 (influences HLA class II expression)
  ENST ID: ENST00000381984
  CDS Start-End: 1-258
atgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatgtccagggccccctggagcatgattttggaatcttcaccataaacttaaactactgttggcatttataccaaatgaaaaagacgcctgccacttcgacctttatgctctcagggaaaataaatggctttgtagacactgctagaggtca

SEQ ID NO: 174929 - DNA, 9307 bp, Homo sapiens
  Payload ID: 14346
  Gene Symbol: RFX3
  Gene Name: regulatory factor X, 3 (influences HLA class II expression)
  Uniprot ID: P48380
  ENST ID: ENST00000382004
  CDS Start-End: 313-2562
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtatggagagagaatacagagcatttttattatagtgctagagggtttggaaggtcatctatttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatgattaaaacacaagaaaggcacatctgttcatttaaatagttgtaaaaaactaatcagcaaaaataaatagataataaagccaaaaaaaaggaaagcacaaaatgattgacagattatcaaatgaggcctatattaaacccaagatgtttatctttccagtggtattggggtaaggggggtggggggttggaaagacgaggtgagccagtctgtaaagttagaaataccaaatggcttatcgggtaatacacagtgtatttaagctgttgttgcttaattgcctcagactactcaaataacatcaacaacatttcttaagtaaaatttaaatattttagatgtaattttaaaaactgatccaaattttttattatacaactcactcatatatttgaaagtcttcactagcatagtagcatcaccttcatctaaatgtcatttaaattactgtccccctttttcctcccaaaaagacaatggatttgtaccaaaacacacacaaaaaaggcaaacaaaacatgataatctgcaaaagttcatgtatctacttcattgtgcataggaagtgtttacaggtaaaattaaaatcaaaaattgaaaaaacactcttcattttggctctcctttctgaattttttcagtttcctgtctctacccgccatcctttgagtgatactatatctgtattggaccaaatgtatttactggtttcattttgtttattgaatgactttaaatgtatttattatcattgtttaatttaatgttggatatatttgtatcattacaggaatctggtaataatgggcaaatttagattgatgaggcttagggatcggggatgctccaggattcaacatttcttccaattgttcatggtttgttctaaattaggacagattaagaactaataaaacattattacatttgaacttgactcaataaaaatattctgatctcctttatgaatattaggaatattctttgtgattagtgtaagtagtttggatcaaaacataaaaagaagacctatggtttatgctacttctagttatttgtagttcacagtaaaacatgcacagacatacacacaaacattttcatcaatttcgaatttgaattgtgaaaaatatataagaaaataaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagtaaagccttaggaagaaaggagttcgagtggattaagagaatctgaactctttgggggcagttaggctatttggagttagatcgctcataaaatattgtttgcgaatttcacacagggcataattttatctatgctccaaaactttaatacgttgtcaaaaaattatatatagatagaatggagagcaaagcacttgattttaagctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttacaaata

SEQ ID NO: 174930 - DNA, 869 bp, Homo sapiens
  Payload ID: 14346
  Gene Symbol: RFX3
  Gene Name: regulatory factor X, 3 (influences HLA class II expression)
  ENST ID: ENST00000449190
  CDS Start-End: 454-869
cttccctcccccacccctccccgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagcagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaa

SEQ ID NO: 174931 - DNA, 814 bp, Homo sapiens
  Payload ID: 14346
  Gene Symbol: RFX3
  Gene Name: regulatory factor X, 3 (influences HLA class II expression)
  ENST ID: ENST00000458034
  CDS Start-End: 293-814
cagaaaatacaaatgtgcatagacagctctgggggagtgttttatatatctgtctgtctctctcggtatatatagccagctgtatggcaccagtgcaatggtggtatagttctaacctcagtaatatttggtaaacttaaactatttttaaagtccattttcttttttatcctcatttgccatctattcatttgctacatttattcacaccagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatgg

SEQ ID NO: 174932 - DNA, 822 bp, Homo sapiens
  Payload ID: 14346
  Gene Symbol: RFX3
  Gene Name: regulatory factor X, 3 (influences HLA class II expression)
  ENST ID: ENST00000457373
  CDS Start-End: 174-822
actacaaacagtactttaaagacaggccttccactgccattcagaaagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgg

SEQ ID NO: 174933 - DNA, 526 bp, Homo sapiens
  Payload ID: 14346
  Gene Symbol: RFX3
  Gene Name: regulatory factor X, 3 (influences HLA class II expression)
  ENST ID: ENST00000442560
  CDS Start-End: 1-408
gtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacactttttctgttttcctgtgtccctttttccctaggccaactcagtccctgaaatgaaactcctcagacagattaccatgaaccgtctgtttcctacactaaatcataaattgactgaaggttctgggcctcattttcaaagcatttaataaaatgggactttgaatgac

SEQ ID NO: 174934 - DNA, 740 bp, Homo sapiens
  Payload ID: 14346
  Gene Symbol: RFX3
  Gene Name: regulatory factor X, 3 (influences HLA class II expression)
  ENST ID: ENST00000451859
  CDS Start-End: 189-740
acttctgcttccactacaaacagtactttaaagacaggccttccactgccattcagaaagcagccatggaggatactctagtttctttgggaagataaacactcaatctgctagttaagagacaaagctcaagagaaataagctgaagctgtaacctccatttcaaacttgtggttctgcagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatgta

SEQ ID NO: 174935 - DNA, 633 bp, Homo sapiens
  Payload ID: 14346
  Gene Symbol: RFX3
  Gene Name: regulatory factor X, 3 (influences HLA class II expression)
  ENST ID: ENST00000449234
  CDS Start-End: 1-375
gagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcact

SEQ ID NO: 174936 - DNA, 492 bp, Homo sapiens
  Payload ID: 14346
  Gene Symbol: RFX3
  Gene Name: regulatory factor X, 3 (influences HLA class II expression)
  ENST ID: ENST00000420720
  CDS Start-End: 1-471
gtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacagccaactcagtccctgaaatgaaactcctcagacagattaccatgaaccgtctgtttcctacactaaatcataaattgactgaaggttctgggcctcattttcaaagcatttaataaaatgggactttgaatgac

SEQ ID NO: 174937 - DNA, 9253 bp, Homo sapiens
  Payload ID: 14346
  Gene Symbol: RFX3
  Gene Name: regulatory factor X, 3 (influences HLA class II expression)
  Uniprot ID: P48380
  ENST ID: ENST00000617270
  CDS Start-End: 264-2513
ccctcccccacccctccccgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgagtttggtgatttaaatgccgtgtctcctggaaatctggataaagatgaaggcagtgaagtagaaagtgaaatggatgaagaactggatgactcttcagagcctcaagccaaaagagagaaaacagagctgagccaggcatttccagtgggctgcatgcagcctgttctcgagactggcgtgcaaccaagcctcctgaatccaattcacagcgagcacattgtcacaagtactcagactatcagacagtgcagcgctacaggaaatacctacactgcagtctaaagaatattaaagcgtatttttccagcttacattaaccctgttgatattgggcttaagttgaaaatttaataagcctgaaggtcgactgttgtcaaattctatctgtgctgaacattaactttttggagttgtgaaatggaatgggtgtatgtattttgccagatctttttttttaacgtaaacaaattatttgcttcttaataatgaattttttcccttagtttcaggtgtcaagaaggatttttacaacacttaatgtcaatgttttgttttcttataattaaaaagtaatttacattttttgtagcttaaaatattttattgttgattgttagtcttggtgtatgatttcatgtgtaagttttttaattagatgcacttctgtgaaatatcaaaagaaatgatttttttgatttacactggaggcatgcccatttggcagcagatgcatcaaatttgcttttgaaaggtgcttttcattggacagaaccataagacactattttgataacattttgagtatggagagagaatacagagcatttttattatagtgctagagggtttggaaggtcatctatttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctattacatggtgccttaaaacagaactgaagctaaggtttagtaaggtttattttgttcatgtgactaactcttcaatccatttgacaaagtgtgcctgtcattttcagattcctgaagtaaggacaggtgacatgttcttcaaaggaaatttagggaaaacaaaggaaaacaaaaagacaaaaatcagtttccctctttgagtgaccgtggatctattttttattcttagagctgaatattacttgattacaaatcagattgcttaagggtgtggaatagcaggctagttttaataccaacttgttaacataaaatcatatatgttttagaccattcttatttagttacaattttagaaagttaacaaagtaagcaggtacttatcgaagtgcatcttttcagtctaaatgtttgtctgtgtgtctaggtgctggtgagtccacatggacacatgagtgcccatggggcaggagtctgctataaagtcagaaggtgagatcctagagagttacacccagccccattttaatttgcatgaaaagccaaggttcttttaagcactcaaattatttaatgattaaaacacaagaaaggcacatctgttcatttaaatagttgtaaaaaactaatcagcaaaaataaatagataataaagccaaaaaaaaggaaagcacaaaatgattgacagattatcaaatgaggcctatattaaacccaagatgtttatctttccagtggtattggggtaaggggggtggggggttggaaagacgaggtgagccagtctgtaaagttagaaataccaaatggcttatcgggtaatacacagtgtatttaagctgttgttgcttaattgcctcagactactcaaataacatcaacaacatttcttaagtaaaatttaaatattttagatgtaattttaaaaactgatccaaattttttattatacaactcactcatatatttgaaagtcttcactagcatagtagcatcaccttcatctaaatgtcatttaaattactgtccccctttttcctcccaaaaagacaatggatttgtaccaaaacacacacaaaaaaggcaaacaaaacatgataatctgcaaaagttcatgtatctacttcattgtgcataggaagtgtttacaggtaaaattaaaatcaaaaattgaaaaaacactcttcattttggctctcctttctgaattttttcagtttcctgtctctacccgccatcctttgagtgatactatatctgtattggaccaaatgtatttactggtttcattttgtttattgaatgactttaaatgtatttattatcattgtttaatttaatgttggatatatttgtatcattacaggaatctggtaataatgggcaaatttagattgatgaggcttagggatcggggatgctccaggattcaacatttcttccaattgttcatggtttgttctaaattaggacagattaagaactaataaaacattattacatttgaacttgactcaataaaaatattctgatctcctttatgaatattaggaatattctttgtgattagtgtaagtagtttggatcaaaacataaaaagaagacctatggtttatgctacttctagttatttgtagttcacagtaaaacatgcacagacatacacacaaacattttcatcaatttcgaatttgaattgtgaaaaatatataagaaaataaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagtaaagccttaggaagaaaggagttcgagtggattaagagaatctgaactctttgggggcagttaggctatttggagttagatcgctcataaaatattgtttgcgaatttcacacagggcataattttatctatgctccaaaactttaatacgttgtcaaaaaattatatatagatagaatggagagcaaagcacttgattttaagctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttac

SEQ ID NO: 174938 - DNA, 3378 bp, Homo sapiens
  Payload ID: 14347
  Gene Symbol: RFX4
  Gene Name: regulatory factor X, 4 (influences HLA class II expression)
  Uniprot ID: Q33E94
  ENST ID: ENST00000229387
  CDS Start-End: 119-2044
agagtgagttccaggtgggaaggcagttatgacagttgagaagtagtagaagacacggaaggcacagaaggcagacttcgctcagcacaaagaattttctgataaccatactggcaaaatgaactgggctgccttcggagggtctgaattcttcatcccagaaggcattcagatagattcgagatgcccactaagcagaaatatcacggaatggtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacga

SEQ ID NO: 174939 - DNA, 2565 bp, Homo sapiens
  Payload ID: 14347
  Gene Symbol: RFX4
  Gene Name: regulatory factor X, 4 (influences HLA class II expression)
  Uniprot ID: Q33E94
  ENST ID: ENST00000357881
  CDS Start-End: 141-2375
gttgccatggcaacccactgacctgagccaccccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacagg

SEQ ID NO: 174940 - DNA, 3955 bp, Homo sapiens
  Payload ID: 14347
  Gene Symbol: RFX4
  Gene Name: regulatory factor X, 4 (influences HLA class II expression)
  Uniprot ID: Q33E94
  ENST ID: ENST00000392842
  CDS Start-End: 415-2622
atctgacgagcggccattcatcaggccggctggcctatcaatgacattgctcccatcggggctcctataaaatgatgctttttcccatgaaacatccgcaaacattttgacgggtttggctttgcccggctggattactgagtgtccccttgctcgctcgctttttctctctcccccttctccgagctcgctcccttctctccctctctctcctcttttcttctttctcttttctttcctcttctttttcttttcttttcctttcctcctttatccttgtgccccctcactttctgcgtctctctctctccccttctccctccctccctcccttcctccctgggcatctctagcacaggggatccccaaacatcaggacttttggggggcgcctgtgctgtccatgggaagagcatgcattgtgggttactggaggaacccgacatggattccacagagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggagcaatgcagtcttacacgtggtctctaacatacacagtgacgacggctgctgggtccccagctgagaactcccaacagctgccctgtatgaggaacactcatgtgccttcttcctccgtcacacacaggataccagtttatccccacagagaggaacatggatacacgggaagctataactatgggagctatggcaaccagcatcctcaccccatgcagagccagtatccggccctccctcatgacacagctatctctgggccactccactatgccccttaccacaggagctctgcacagtacccttttaatagccccacttcccggatggaaccttgtttgatgagcagtactcccagactgcatcctaccccagtcactccccgctggccagaggtgccctcagccaacacgtgctacacaagcccgtctgtgcattctgcgaggtacggaaactctagtgacatgtatacacctctgacaacgcgcaggaattctgaatatgagcacatgcaacactttcctggctttgcttacatcaacggagaggcctctacaggatgggctaaatgactgctatcataggcatccatatttaatattaataataataattaataataataataaacccaacacccatcccccagaagactttatctctatacattgtaactcatgggctattcctaagtgcccattttcctaatgaacatgaggatgggatcaatgtgggatgaataaactttagttcagaaacaggacttactaaaagtcagtgggactgggtttctgtagccaagccagacttgactgtttctgtagagcactatctcgggcaggccattctgtgccttttccctctgttccatgactttgctttgtgttggcaaccacttctagtaagctactgattttcctgttgacaaaatctctttagtcttgaaggatggatactggagacagaatctggtttgtgttcttggatgggcacataatttaccaagagcattcaccttgccatctgtcttgtcattgtactgtacaaggaacagccctcagacgtgttctgcacatcccttcttcctggtggtaccatccctatttcctggagcaccagggctaaatggggagctatctggaaactctagattttctgtcatacccacatctgtcacagtacctgcattgtcttggaatgtaagcactgtcttgagggaaggaagaggtctgttctgtattgccttaagttgattgaggtttgtaggagactggttcttctacatacaaggatttgtcttaagtttgcacaatggctagtgtcagcaaaaggcaggagagggtttttgttttttttttaagttctatgagaatgtggatttatggcattgagtatcacactcagctctgctgtgttaactttgtgaaactggatggaacaaactttaacttaccaagcaccaagtgtgaaagtgactttcacggttccttcataaaactataataatatccgacactttgatagaaaaaaattcaaagctgtgcctttgagcctatactatactgtgtatgtgtggaaataaaaatgtattgtacttttggagaattttttgtaggcatttttctgtcagatttgtagtaatttgtgaggtttgttagagattaatataggttttctttctgtattataaaatgcaccaagcaattatggtggacctattaccctatgggtaagaaataaatggaaatatgacatcggatgtttcagcaactgttctgtaaataaaatctttgatcacaccactcagtgtgataattgtgtctacagctaaaatggaaatagttttatctgtacagttgtgcaagatatgaatggtttcacactcaaataaaaaatattgaaacg

SEQ ID NO: 174941 - DNA, 1228 bp, Homo sapiens
  Payload ID: 14347
  Gene Symbol: RFX4
  Gene Name: regulatory factor X, 4 (influences HLA class II expression)
  ENST ID: ENST00000536722
  CDS Start-End: 112-855
accccctggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccg

SEQ ID NO: 174942 - DNA, 660 bp, Homo sapiens
  Payload ID: 14347
  Gene Symbol: RFX4
  Gene Name: regulatory factor X, 4 (influences HLA class II expression)
  ENST ID: ENST00000546882
  CDS Start-End: 289-522
cggctggattactgagtgtccccttgctcgctcgctttttctctctcccccttctccgagctcgctcccttctctccctctctctcctcttttcttctttctcttttctttcctcttctttttcttttcttttcctttcctcctttatccttgtgccccctcactttctgcgtctctctctctccccttctccctccctccctcccttcctccctgggcatctctagcacaggggatccccaaacatcaggacttttggggggcgcctgtgctgtccatgggaagagcatgcattgtgggttactggaggaacccgacatggattccacagatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagcaataaatgagagttcctgttgctctacatcctcaccagcatttggtgttgtcagtgttccaggttttggccattctaatagatcataaggcagcagtttcctcagttaaccaccagaagactcgggacccgaggacagtcaaa

SEQ ID NO: 174943 - DNA, 473 bp, Homo sapiens
  Payload ID: 14347
  Gene Symbol: RFX4
  Gene Name: regulatory factor X, 4 (influences HLA class II expression)
  ENST ID: ENST00000549040
  CDS Start-End: 297-473
aaagatgcgctggctcgcggcgagctcgaggtgccacttgcagaaactttgccagccgaccgccccctcccggacccaggtcctcctaggagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgat

SEQ ID NO: 174944 - DNA, 798 bp, Homo sapiens
  Payload ID: 14347
  Gene Symbol: RFX4
  Gene Name: regulatory factor X, 4 (influences HLA class II expression)
  ENST ID: ENST00000551640
  CDS Start-End: 30-798
tgccactagatgtgactgtgtccctccggatgacctcagctacagatggagaaaggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaat

SEQ ID NO: 174945 - DNA, 594 bp, Homo sapiens
  Payload ID: 14347
  Gene Symbol: RFX4
  Gene Name: regulatory factor X, 4 (influences HLA class II expression)
  ENST ID: ENST00000552917
  CDS Start-End: 7-126
ggcaaaatgaactgggctgccttcggagggtctgaattcttcatcccagaaggcattcagatagattcgagatgcccactaagcagaaatatcacggaatgtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctct

SEQ ID NO: 174946 - DNA, 1053 bp, Homo sapiens
  Payload ID: 14347
  Gene Symbol: RFX4
  Gene Name: regulatory factor X, 4 (influences HLA class II expression)
  ENST ID: ENST00000539967
  CDS Start-End: 618-1053
gttattatatcattccgaaaggactggaacaaccgactcacagcaagtgctggggcgaagtaggaaacgtccaggataagagaggccggcgagcggggccaccgtcccttactcttaaaaggaaaatccccgcgaagtgcctcgggcccgggagaacagttttgcaggggccagggctctagtggcctgctttggggccacttcagcatgacctgcggaaacgcgcccctttgttccgcacactgagccaagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaat

SEQ ID NO: 174947 - DNA, 3576 bp, Homo sapiens
  Payload ID: 14348
  Gene Symbol: RFX5
  Gene Name: regulatory factor X, 5 (influences HLA class II expression)
  Uniprot ID: P48382
  ENST ID: ENST00000290524
  CDS Start-End: 180-2030
ccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 174948 - DNA, 2459 bp, Homo sapiens
  Payload ID: 14348
  Gene Symbol: RFX5
  Gene Name: regulatory factor X, 5 (influences HLA class II expression)
  Uniprot ID: P48382
  ENST ID: ENST00000368870
  CDS Start-End: 252-2102
cgtgtatctaggcagatcgcggctgttacaaccattcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaaccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttat

SEQ ID NO: 174949 - DNA, 2056 bp, Homo sapiens
  Payload ID: 14348
  Gene Symbol: RFX5
  Gene Name: regulatory factor X, 5 (influences HLA class II expression)
  ENST ID: ENST00000392746
  CDS Start-End: 267-2056
ttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctggccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaagga

SEQ ID NO: 174950 - DNA, 585 bp, Homo sapiens
  Payload ID: 14348
  Gene Symbol: RFX5
  Gene Name: regulatory factor X, 5 (influences HLA class II expression)
  ENST ID: ENST00000430227
  CDS Start-End: 217-585
agtgaaggtggctacgaggtagtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagt

SEQ ID NO: 174951 - DNA, 2355 bp, Homo sapiens
  Payload ID: 14348
  Gene Symbol: RFX5
  Gene Name: regulatory factor X, 5 (influences HLA class II expression)
  Uniprot ID: P48382
  ENST ID: ENST00000452671
  CDS Start-End: 279-2129
gcagcagtgaccaatgacagagcaggccgcccgtgtatctaggcagatcgcggctgttacaaccattcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgacctta

SEQ ID NO: 174952 - DNA, 545 bp, Homo sapiens
  Payload ID: 14348
  Gene Symbol: RFX5
  Gene Name: regulatory factor X, 5 (influences HLA class II expression)
  ENST ID: ENST00000436271
  CDS Start-End: 257-545
agcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatcc

SEQ ID NO: 174953 - DNA, 765 bp, Homo sapiens
  Payload ID: 14348
  Gene Symbol: RFX5
  Gene Name: regulatory factor X, 5 (influences HLA class II expression)
  ENST ID: ENST00000436637
  CDS Start-End: 1-708
ccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggaagtccattctcctctgtacagacagctgagtcacccagtctacttagtacctggttgctgcctctgaccttttcagcttgataccctgggctttagtgtaaccaataaatctgtagtgacctta

SEQ ID NO: 174954 - DNA, 562 bp, Homo sapiens
  Payload ID: 14348
  Gene Symbol: RFX5
  Gene Name: regulatory factor X, 5 (influences HLA class II expression)
  ENST ID: ENST00000412774
  CDS Start-End: 210-562
agtgaaggtggctacgaggtagtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcg

SEQ ID NO: 174955 - DNA, 903 bp, Homo sapiens
  Payload ID: 14348
  Gene Symbol: RFX5
  Gene Name: regulatory factor X, 5 (influences HLA class II expression)
  ENST ID: ENST00000450506
  CDS Start-End: 351-903
aaccggggattgaatggagggggaagggaaggaggtgggggcgcgcctcaggatgggctgttgtgggagatgacgtaggggccggcgacgtggggagggggagcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgaga

SEQ ID NO: 174956 - DNA, 902 bp, Homo sapiens
  Payload ID: 14348
  Gene Symbol: RFX5
  Gene Name: regulatory factor X, 5 (influences HLA class II expression)
  ENST ID: ENST00000422595
  CDS Start-End: 214-902
agcgcatgagttccgctaccccgccccacccccgctccactttgcagaaaccggggattgaatggagggggaagggaaggagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcct

SEQ ID NO: 174957 - DNA, 558 bp, Homo sapiens
  Payload ID: 14348
  Gene Symbol: RFX5
  Gene Name: regulatory factor X, 5 (influences HLA class II expression)
  ENST ID: ENST00000421986
  CDS Start-End: 188-322
tttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttcgccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcc

SEQ ID NO: 174958 - DNA, 567 bp, Homo sapiens
  Payload ID: 14348
  Gene Symbol: RFX5
  Gene Name: regulatory factor X, 5 (influences HLA class II expression)
  ENST ID: ENST00000452456
  CDS Start-End: 213-365
aacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgtagaaacggggtttcaccatgttagccaggatggtctcgatctcctgaccttgtgatcagcctgccttggccttccaaagtgctgggattgtaggcgtgagccaccgtgcccggccttgtcaaataatttctaaggtcctttttcagtctgacaccctcaagatgtacagaaattttctgacaatgacaagctgtatctctacct

SEQ ID NO: 174959 - DNA, 537 bp, Homo sapiens
  Payload ID: 14348
  Gene Symbol: RFX5
  Gene Name: regulatory factor X, 5 (influences HLA class II expression)
  ENST ID: ENST00000458484
  CDS Start-End: 42-537
ttttccagatttaggagacttcagaaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataagga

SEQ ID NO: 174960 - DNA, 596 bp, Homo sapiens
  Payload ID: 14348
  Gene Symbol: RFX5
  Gene Name: regulatory factor X, 5 (influences HLA class II expression)
  ENST ID: ENST00000444392
  CDS Start-End: 222-374
attcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgtagaaacggggtttcaccatgttagccaggatggtctcgatctcctgaccttgtgatcagcctgccttggccttccaaagtgctgggattgtaggcgtgagccaccgtgcccggccttgtcaaataatttctaaggtcctttttcagtctgacaccctcaagatgtacagaaattttctgacaatgacaagctgtatctctaccttcagctcccctcaggaccca

SEQ ID NO: 174961 - DNA, 597 bp, Homo sapiens
  Payload ID: 14348
  Gene Symbol: RFX5
  Gene Name: regulatory factor X, 5 (influences HLA class II expression)
  ENST ID: ENST00000437327
  CDS Start-End: 281-597
ttcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctggccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacac

SEQ ID NO: 174962 - DNA, 583 bp, Homo sapiens
  Payload ID: 14348
  Gene Symbol: RFX5
  Gene Name: regulatory factor X, 5 (influences HLA class II expression)
  ENST ID: ENST00000435314
  CDS Start-End: 196-324
ttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgagcaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcgggactcttcgagcctacccatggcctccttctctgagtatcttcc

SEQ ID NO: 174963 - DNA, 3460 bp, Homo sapiens
  Payload ID: 14349
  Gene Symbol: RFX6
  Gene Name: regulatory factor X, 6
  Uniprot ID: Q8HWS3
  ENST ID: ENST00000332958
  CDS Start-End: 17-2803
tccggcggccaggaggatggccaaggtcccggagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggcttgaagagaattacattgtatgtgaaggagtttgcttaccacggtgcattctttatgcacactacttagatttctgtaggaaagagaaattagagccagcctgtgcggccacctttggaaagacaattcgccagaagtttcccctcctaacaacaaggcggcttggaacaagaggccattcaaagtatcattactatgggattggcatcaaagagagcagtgcatattaccactccgtttattctggaaagggcttgacaaggttttctggaagcaagctaaagaatgagggtggcttcactcgtaaatattcgcttagctcaaaaactggaacacttcttccagaattccccagcgctcaacaccttgtataccaaggatgcatttctaaggacaaggttgatacgctcataatgatgtacaaaactcactgccagtgtatcctggacaatgcaattaatggaaactttgaagagatccagcattttttattacacttttggcaaggaatgcctgaccatctccttcccctgctcgaaaatcctgttatcattgatattttctgtgtttgtgactcaattctttataaggttcttacagatgtactcattcctgcaacaatgcaagaaatgcctgaaagcttattagcagacataagaaattttgctaaaaattgggaacagtgggttgtttcatccttggaaaacttgccagaagctctaactgacaagaaaatacctattgtgcgaagatttgtatcttctctgaaacgacaaacatctttcttacatcttgcccagattgccagaccagctctctttgaccagcatgtcgttaattctatggtgtctgatattgaaagggttgatttgaacagcattggctctcaagcccttcttaccatttcaggcagcacagacactgaatctggtatctacactgaacatgactctatcactgtgttccaagaactgaaggatctccttaagaagaatgccactgtggaggcttttattgaatggttggatactgtggtagaacagagagttattaagaccagcaaacaaaatggaaggtcattaaagaagagagctcaagactttctgttaaagtggagtttttttggtgctcgagtaatgcataatctcaccttgaacaatgcatccagttttggttcttttcatttgattcgaatgcttctcgatgaatacattctcctggccatggagacccagtttaataatgacaaagagcaggagttacagaatttattggacaagtatatgaagaattcagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagacaacatgccgctcacaggtcaaatggagctttcacagattgctggtcatctgatgacaccacccatttctccagccatggcaagccgaggaagtgtcattaaccaaggaccaatggcagggaggcccccaagtgtgggcccagtactgtcagctccatcacactgctccacatacccagagcccatttatcccactctccctcaagccaatcatgacttttatagcaccagctctaactaccagactgtgtttagggcacagccccactccacatcaggactctatcctcatcacaccgagcatggtcgatgcatggcttggactgaacagcagctttcaagagacttcttcagtggcagctgtgcggggtctccatataactcccggccaccgtctagctatggcccatccctgcaagcccaggattcacacaatatgcagtttttaaatacaggaagcttcaatttcttgagcaacacaggagctgccagctgccaaggagcaacactgcctcctaattcaccaaatggatactatggaagcaacataaactacccagagtctcacaggctcggatcaatggtgaatcagcacgtttctgtcatcagcagcattcgttcactgcccccctacagtgacatccacgatccacttaacattttagatgacagtggtagaaaacagaccagctcgttttacacagacacatcatctccagttgcatgtcgaactccagtcctagcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgcctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgtcacatagcagcattccgattctatgtaactgaatggagatgataagtgctttcccctctttatttaaaaaagattaaaaggaataaaagaaataatgtatggaaata

SEQ ID NO: 174964 - DNA, 10426 bp, Homo sapiens
  Payload ID: 14350
  Gene Symbol: RFX7
  Gene Name: regulatory factor X, 7
  Uniprot ID: Q2KHR2
  ENST ID: ENST00000559447
  CDS Start-End: 273-4364
agccgccaccacagcagcctgatgcccatcagcagcttccccccagcgcccccaactcgggggtggccctgccagcccttgtgcccgggctgccagggacagaggccagcgcgctgcaacacaagatcaagaactccatctgcaaaactgtacaatctaaagtggactgcattttgcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaactgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatattaaactgactggatctgaaggtgttttatgggacatattttatataggcaacacattttgtaaacagacccaatgttattcttcctttgatgtcattaactttagggagtgaataaaaatgagcagaaggcagaacagtgctgctgatctgctgtgtgctattaatccagaagaatacacagatcttagttcattcatcaaaactctgttgttcacttaagattattaccaatgaatggtgcatggcatagaactttatgttgtccaaaaagccatctttttctctttcacatagtgtttaaatgttagcctatggagtacctaggtaagtatatttctggagctctgaatagaaaatgagaaaattttaagcatagctgtgttcaaaagcagtatagacatttccaggtaccagaaataacaaactgataagtgtaatgaatttgtaagccagaagctgggctacaggtctggaagcaggccgaagtagccagaaatgtcagctcctgcaaagtaatgaaaccagggtcttgaatggagtttcctcactcttgaaactgagaagcaacaacaaccagtgccagggactatatattgtagacagatcttctcaaacagcctactcctctgtttacatagatctttgtagatctgtgatagttccactatcaccatagatctggagccctcagtttgaacaggtggtagaagcaattacaaaaggaaaggagtggagattaggaagggagaggtaaagagcaggaaggctcccatgaaagctgagcctgcagatcaaaattcaaaagtacttgaagaaaaactaatcccaagaaaggcaatcagtcactcaagagaaaatgaaagtaatgaactacctagataatactataaaattagtatgttaggatcctcagtgctcaatgacatggaagggtaaaatgtcagagcaggcaaacataagaaccagtgcatagagtcaaccagtaagaaattctgggggtgaaaatactgtgtaacacctgaggtgattttggtttcaagtaattgaaaacccaacactggcttaaaccataaggacacttacttttagcttaataatagtggagataggaggttcaagggttcattcaatggttcattgtttacaggcaccagatcctgtttgtgtttctgttccatcatcttcagctttgctttgctgtgtctattacctcatagtcacaagatggctgccacagctcagatgttataccctcataacatcccaagcaggatagtaagagcagttcttagccttttatcagagagaaaaaaaaatctcagaatcttccattaagcactccatacacacacactgttagtctcattgtattaaacaaaggctcatcctaaggccaattacttagcttagatccttaattaatgctttataggtaggagggggggcccatttcctggagcatgtggtcattcatcttaaatgagttccatcacctagggaagatattagggacttgctctttgggaggcaaccagtagtggtcactgcaaaaaatagctaggtaagatgagtaagatcttgtacccacctttgaggggcttacaatcataaagagttaagtacatgttctttgttaagtgccaacagtatgtatactacactatgtagaagaaaaaataagaatttgaaatctgccgaactaagtttactggtgctaactgttaactggtatcttgccttccccctatgagctgaaaaatcaggtattattgagtatcacaaatgcaagttgcctcagctcctacagcataagaaaagaccaaactttttattttgttaaatctgaagtacagatttattttgacatgcattgttataaatgaatttttaaataattaaagttataaatttatggatgggatcacttattaatattgcatcatctgaaattttaaaaatatgtatgccagtcttgttgctataatctgcttagaaaaaagaacaaaacaaaaagactacatttttcaagatttgatttttaagaagtacttaattcttggagaggagaagagagtcatataaataaaatatatcatgagagtgatattactgtggtatatagagtatttctttgcattagacccagtgttagtttgcatatattctcatgtcctcattgtaacaatttttagcgagtattatttttcaggtgagaaaattttacttcagagattaactggtggaggtaacataataacaggaagagccaggattatcttaatttcaaatcccacttcataccattatgctatacttaagatatgtgttcacagtgtacctactgcagttgtatgatctggttgcttctttgaaattttcattctggttttaaatttagaattgagtttgatttttgtggagttctttatttaacctcccatccttatatgtcaacaattctttttcatttttattgcttttagatttacctgtagtttgtaattttcctccaaattacttgaatccttttccctcccttctctccatagaaataccctgatgtattaggagaatgaagatttaaaaacaaaattttgttttccacacagcttttcaagcatatttcatacaggtatactctagtcatatttatgtttaaatcacttaaaatgtcatcaaaataaaaatgggactttttttttaacagatgataaagtgcctaaaatatgtcagtctctgtacaaggtgctagagaagacacctgccattttgaaattttgcaatataatgaaaaagacacagtgaatgtctttgcaggatgcaatgaggtcactatagcagaggcggatacttaccagtagtatgcattctccccttcttctttactgtaaaagtccttgatttttagctgagcacacagccatctgaccaaaaggctgcatctgccaacttcccttgcagttaagtggagacacttaccaagtactcaaagagatgtaaccaaaaggtttgggtgctacttctttgcagtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactc

SEQ ID NO: 174965 - DNA, 4165 bp, Homo sapiens
  Payload ID: 14350
  Gene Symbol: RFX7
  Gene Name: regulatory factor X, 7
  ENST ID: ENST00000559847
  CDS Start-End: 49-3879
cagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgaaataccctgatgtattaggagaatgaagatttaaaaacaaaattttgttttccacacagcttttcaagcatatttcatacagtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactcaca

SEQ ID NO: 174966 - DNA, 518 bp, Homo sapiens
  Payload ID: 14350
  Gene Symbol: RFX7
  Gene Name: regulatory factor X, 7
  ENST ID: ENST00000560792
  CDS Start-End: 290-518
aacatctgttttgtggacatctagtttgattcctgttggataaatacttatgcaaaactgtacaatctaaagtggactgcattttgccccctcgggtgaattgtttataagctacctagatacttacctgtatctcatcaataataaaatcacaatctgagaactgctggggcctgagagaatataatatcagcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaat

SEQ ID NO: 174967 - DNA, 1407 bp, Homo sapiens
  Payload ID: 14351
  Gene Symbol: RFXANK
  Gene Name: regulatory factor X-associated ankyrin-containing protein
  Uniprot ID: O14593
  ENST ID: ENST00000303088
  CDS Start-End: 475-1257
agagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 174968 - DNA, 1059 bp, Homo sapiens
  Payload ID: 14351
  Gene Symbol: RFXANK
  Gene Name: regulatory factor X-associated ankyrin-containing protein
  ENST ID: ENST00000392324
  CDS Start-End: 199-912
ctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 174969 - DNA, 1212 bp, Homo sapiens
  Payload ID: 14351
  Gene Symbol: RFXANK
  Gene Name: regulatory factor X-associated ankyrin-containing protein
  Uniprot ID: O14593
  ENST ID: ENST00000407360
  CDS Start-End: 347-1129
aaaagaaggcgcaggcgcaactgccctcccaggaccccagcggaacccacgccctcccctaagtcttaaagggccagaggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggca

SEQ ID NO: 174970 - DNA, 856 bp, Homo sapiens
  Payload ID: 14351
  Gene Symbol: RFXANK
  Gene Name: regulatory factor X-associated ankyrin-containing protein
  ENST ID: ENST00000421262
  CDS Start-End: 607-856
cagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcag

SEQ ID NO: 174971 - DNA, 1325 bp, Homo sapiens
  Payload ID: 14351
  Gene Symbol: RFXANK
  Gene Name: regulatory factor X-associated ankyrin-containing protein
  Uniprot ID: O14593
  ENST ID: ENST00000456252
  CDS Start-End: 462-1178
tccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 174972 - DNA, 374 bp, Homo sapiens
  Payload ID: 14351
  Gene Symbol: RFXANK
  Gene Name: regulatory factor X-associated ankyrin-containing protein
  ENST ID: ENST00000536253
  CDS Start-End: 1-126
cccgaggcgctgacctcaccaccgaagccgactctggctacaccccgatggaccttgccgtggccctgggataccggaaagatggagtttcgctcttgttgcccaggctggagtgctatggcgtgatctcggctcactgcaacttccgcctcccagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaa

SEQ ID NO: 174973 - DNA, 832 bp, Homo sapiens
  Payload ID: 14351
  Gene Symbol: RFXANK
  Gene Name: regulatory factor X-associated ankyrin-containing protein
  ENST ID: ENST00000540981
  CDS Start-End: 269-832
ggcagcacttactgcccgggcccttcctcacttttggggggcgggggtgcgcaagcgcagtgggggagctctggggtgggggtagcggtcgagtatcaagttgctttctgtcccggcagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctg

SEQ ID NO: 174974 - DNA, 288 bp, Homo sapiens
  Payload ID: 14351
  Gene Symbol: RFXANK
  Gene Name: regulatory factor X-associated ankyrin-containing protein
  ENST ID: ENST00000544923
  CDS Start-End: 1-144
cccgaggcgctgacctcaccaccgaagccgactctggctacaccccgatggaccttgccgtggccctgggataccggaaaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgca

SEQ ID NO: 174975 - DNA, 546 bp, Homo sapiens
  Payload ID: 14351
  Gene Symbol: RFXANK
  Gene Name: regulatory factor X-associated ankyrin-containing protein
  ENST ID: ENST00000535017
  CDS Start-End: 1-546
gacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggagacccttcagccacgttcttcagtggagaccaagatagcagagcccgaggcgctgacctcaccaccgaagccgactctggctaca

SEQ ID NO: 174976 - DNA, 865 bp, Homo sapiens
  Payload ID: 14351
  Gene Symbol: RFXANK
  Gene Name: regulatory factor X-associated ankyrin-containing protein
  ENST ID: ENST00000593273
  CDS Start-End: 431-865
ggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtgg

SEQ ID NO: 174977 - DNA, 2304 bp, Homo sapiens
  Payload ID: 14352
  Gene Symbol: RFXAP
  Gene Name: regulatory factor X-associated protein
  Uniprot ID: O00287
  ENST ID: ENST00000255476
  CDS Start-End: 135-953
gcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggaaagtgcagataacatactctccattgttaaacaaagaacaggatcttttggggatcgtcctgcaagacctactcttttagaacaagtgttaaatcaaaaaagactgtcgttactaagaagtccagaagtagtgcaatttttacagaaacagcaacagctattaaatcagcaagttttggagcaaagacaacagcagtttccaggaacatcaatgtgagggaacttaccaagaacatctacatggttttttatcttattgtaatagatgagcatatttttttaccagacataaatggggtaataatctatgcctgtagaacataaacattttcctgtaaatgtatgtgtgcatttggggataagtaagtattgcactttgtgcatctaatctttcagattactgtgagtttgaagaagtcagcttatctttccaaataacatttaattataatgttttttaaaaaatatattcctcttcagtcattgttactgaaggtaatgaagcagttactttctgtggaagtcataaagttaatagatattaatcttgactcatctagctcagtggttctcatcaagggtcaatttgattgtcatagtgaccttgaaaaccactggcttttagtgagtggccaggaatgctaaatgttctgcagtgtcaggggtagtcccacatactaaagattgtctcacccgcagtgccaataacactcctaagaaatgttgatggctattttgtggtgctaacatgtagttggggcacctataattgggttctcttaataacctttctttgcagttaagactgaagctgtcaaagaggtaagcacattttatatagacgtaaggaaagtgattattgtttaatatctgtgaatttaggatgtgcatctcttttcagaggtgtgttagtaaaacctgacggattaactaagcacactgggatgtgtctcctacagttggcttctctctttgatgttacctgttagtgctgatctcttaaagcagacatttcttgtttgttgaatttgtgaacagtatagatctcagcccaccaatgccaagacaaaattatttttcttatacttattttttattaaacaaaatgaaaaagatccttttcaaaaaggtgatcctgaaaataaaactaacactccagtattttgtcattgtttttcgcaattgagctatctgaaaactgttattcctaagtaatgttcaaaaatgataagtaatctggatacctttttcttatactttctcctaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttga

SEQ ID NO: 174978 - DNA, 1854 bp, Homo sapiens
  Payload ID: 14353
  Gene Symbol: RSC1A1
  Gene Name: regulatory solute carrier protein, family 1, member 1
  Uniprot ID: Q92681
  ENST ID: ENST00000345034
  CDS Start-End: 1-1854
atgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatga

SEQ ID NO: 174979 - DNA, 449 bp, Homo sapiens
  Payload ID: 14354
  Gene Symbol: RIIAD1
  Gene Name: regulatory subunit of type II PKA R-subunit (RIIa) domain containing 1
  Uniprot ID: A6NNX1
  ENST ID: ENST00000479191
  CDS Start-End: 1-279
atggagacgctgccaggcttgctgcagcggcccgaccccggggcgcttagcgcagcgcagctggagcagctgcgaaaattcaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttc

SEQ ID NO: 174980 - DNA, 1772 bp, Homo sapiens
  Payload ID: 14354
  Gene Symbol: RIIAD1
  Gene Name: regulatory subunit of type II PKA R-subunit (RIIa) domain containing 1
  ENST ID: ENST00000326413
  CDS Start-End: 1288-1596
atcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccaatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggggctctgagatagggagacaacagaaaaagacaaacagcgatggagatgaaaactgttgatttgtgaggggcctccacagagaaaaacagggaaggtaacaagaaatgcatgcatctacagcaagaaagatggatgctacagagagagagggggacttcctggtgatgagaggaggtggaaattatgctcagtgtcaggagggtgagtgaagacatctgcagcagaatttatgagagtgcacaaagaattgattctataaccttcctgccctcaagtggcttccacctcaagtggaagattcagactcggattgctaacgaaaagtacctaaggacccacaaagaagtagagtggctcataagtggtttcttcagagaaatatttttgaaaagaccagacaacatcctagaatttgctgcagactacttcacggatccaagacttcccaacaagattcacatgcagctaattaaagacaagaaagcggcttaattagcaaaatcatgatgctcagctgttgggagagaccagacggaatccagcctcgggggtcatctggaggcatgagagccctactgccatcagtgtgggtttccaagctgccttgggctctgtctactgtcgcaaaagcttttaaagatattcattaaacacggaccttcctgctc

SEQ ID NO: 174981 - DNA, 1044 bp, Homo sapiens
  Payload ID: 14355
  Gene Symbol: RRAS
  Gene Name: related RAS viral (r-ras) oncogene homolog
  Uniprot ID: P10301
  ENST ID: ENST00000246792
  CDS Start-End: 104-760
agagctcatgattatgcagtagcctcattagcgtagcccgcccccccgggtcccgcccggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaacgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtca

SEQ ID NO: 174982 - DNA, 1516 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000256196
  CDS Start-End: 315-929
cagacggccatttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaa

SEQ ID NO: 174983 - DNA, 1884 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000414023
  CDS Start-End: 128-511
gcagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgt

SEQ ID NO: 174984 - DNA, 982 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000532814
  CDS Start-End: 372-755
attgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaagtactgtgtatttctttgttcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaa

SEQ ID NO: 174985 - DNA, 497 bp, Homo sapiens
  Payload ID: 14356
  Gene Symbol: RRAS2
  Gene Name: related RAS viral (r-ras) oncogene homolog 2
  ENST ID: ENST00000531421
  CDS Start-End: 290-497
aatatttttgaactgtggttgactgtgggtaactgaaaccaaggaaagtgaaactggggataagcaaggtactgtagttttctttgatcagcacctgaaagatactgtgccacttcttctgatccccatggtttctgatgagaaatctgctgtttttctcctgtagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcac

SEQ ID NO: 174986 - DNA, 1278 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000529237
  CDS Start-End: 240-623
atctcagatgcatgcagctcctgctgggcggtttcattctctgccagccattcattcacattaaaagcaatggcccattaaggaaataagtggatgatgctcctccatcacccatgtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcattta

SEQ ID NO: 174987 - DNA, 970 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000526063
  CDS Start-End: 353-736
attgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaatcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatat

SEQ ID NO: 174988 - DNA, 732 bp, Homo sapiens
  Payload ID: 14356
  Gene Symbol: RRAS2
  Gene Name: related RAS viral (r-ras) oncogene homolog 2
  ENST ID: ENST00000531807
  CDS Start-End: 235-732
aaaagcacacttgatgtatttgtatttctattaaaactgcaattgatggctactgataaaagctagtatagagctgaagatttgcagtggtgtcctctccaaaacgtagtttaggaatactatcatatgattactaatgttgtataaatgcatgagaatgacagataccaaattcaggatattgattacctcttggtgttgggggaggagagaggggaatattattgaggaggcatgcaagagtcttcaatcatattacaaatgttttgtttcctaagtcgggagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctcct

SEQ ID NO: 174989 - DNA, 888 bp, Homo sapiens
  Payload ID: 14356
  Gene Symbol: RRAS2
  Gene Name: related RAS viral (r-ras) oncogene homolog 2
  ENST ID: ENST00000532950
  CDS Start-End: 278-421
ggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagaatcatttgttgaagaaatacctccactgtgaatagtatagtacctggatgctctagatgatattaaagaagtaaaggaagcagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcag

SEQ ID NO: 174990 - DNA, 815 bp, Homo sapiens
  Payload ID: 14356
  Gene Symbol: RRAS2
  Gene Name: related RAS viral (r-ras) oncogene homolog 2
  ENST ID: ENST00000526717
  CDS Start-End: 286-444
ctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccaggtctttcgaaactcttgggttccttctttcattcatgtatttcaaatttgaaagctacaagaattgttttccttccatccatatctcctagcaacccagttaaacccacagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtgagaaggaa

SEQ ID NO: 174991 - DNA, 993 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000534746
  CDS Start-End: 212-595
gtggtattcaggtgatgaatgtggattccgttttgagttggagaaatttctttttgtcagtttggatttaattttaagaaataatgagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatataggg

SEQ ID NO: 174992 - DNA, 2034 bp, Homo sapiens
  Payload ID: 14356
  Gene Symbol: RRAS2
  Gene Name: related RAS viral (r-ras) oncogene homolog 2
  Uniprot ID: P62070
  ENST ID: ENST00000537760
  CDS Start-End: 114-623
atctcagatgcatgcagctcctgctgggcggtttcattctctgccagccattcattcacattaaaagcaatggcccattaaggaaataagtggatgatgctcctccatcacccatgtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatc

SEQ ID NO: 174993 - DNA, 612 bp, Homo sapiens
  Payload ID: 14356
  Gene Symbol: RRAS2
  Gene Name: related RAS viral (r-ras) oncogene homolog 2
  ENST ID: ENST00000545643
  CDS Start-End: 1-612
atggccgcggccgctggcggacggctccggcaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctag

SEQ ID NO: 174994 - DNA, 967 bp, Homo sapiens
  Payload ID: 14357
  Gene Symbol: RLN1
  Gene Name: relaxin 1
  Uniprot ID: P04808
  ENST ID: ENST00000223862
  CDS Start-End: 128-685
ggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccacttt

SEQ ID NO: 174995 - DNA, 1177 bp, Homo sapiens
  Payload ID: 14358
  Gene Symbol: RLN2
  Gene Name: relaxin 2
  Uniprot ID: P04090
  ENST ID: ENST00000381627
  CDS Start-End: 390-947
tcaaatttgtttctgtgtgtgtaaaaggaaaggcttcatatctaaaatgactttacctcagtatactaaattgtttgagggtaatgaatgagaagaacacaactgtaaaagggccaaggacagagggatgggcaaatgaaggaaaggcagagagggagaccaagagctgagggggaaaattctgtggaggggtgtgggaaaggggtggagctggcacccttgccttaaaagctgagtgatagcccaagggatacaaaagaccgcttgagccgggtagggaaagcagcctaaagcccgggacaggcacacaggcccaggtgtgtaggccacagcagctgcagtcctgaaaggctgcaacgtcccgacctccaggagagaccaggcccaggatgcctcgcctgttttttttccacctgctaggagtctgtttactactgaaccaattttccagagcagtcgcggactcatggatggaggaagttattaaattatgcggccgcgaattagttcgcgcgcagattgccatttgcggcatgagcacctggagcaaaaggtctctgagccaggaagatgctcctcagacacctagaccagtggcagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctg

SEQ ID NO: 174996 - DNA, 733 bp, Homo sapiens
  Payload ID: 14358
  Gene Symbol: RLN2
  Gene Name: relaxin 2
  ENST ID: ENST00000416837
  CDS Start-End: 1-206
gcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacattt

SEQ ID NO: 174997 - DNA, 580 bp, Homo sapiens
  Payload ID: 14359
  Gene Symbol: RLN3
  Gene Name: relaxin 3
  Uniprot ID: Q8WXF3
  ENST ID: ENST00000431365
  CDS Start-End: 58-486
gccaagaggcagcagagacactggcccactctcacgttcaaagcatctccgtccagcatggccaggtacatgctgctgctgctcctggcggtatgggtgctgaccggggagctgtggccgggagctgaggcccgggcagcgccttacggggtcaggctttgcggccgagaattcatccgagcagtcatcttcacctgcgggggctcccggtggagacgatcagacatcctggcccacgaggctatgggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctagtttgagggctgggcagccgtgggcaccaggaccaatgccccagtcctgccatccactcaactagtgtctggctgggcacctgtctttcgagcct

SEQ ID NO: 174998 - DNA, 541 bp, Homo sapiens
  Payload ID: 14359
  Gene Symbol: RLN3
  Gene Name: relaxin 3
  ENST ID: ENST00000585987
  CDS Start-End: 1-330
atggccaggtacatgctgctgctgctcctggcggtatgggtgctgaccggggagctgtggccgggagctgaggcccgggcagcgccttacggggtcaggctttgcggccgagaattcatccgagcagtcatcttcacctgcgggggctcccggtggagacgatcagacatcctggcccacgaggctatggaaaagaacattgaggctccaagaagtaaatttacttgctcacgattagagaagctggattcatgctcagtcagcccagctcccaaatgtaccaggtcctcaattaataaagagagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctag

SEQ ID NO: 174999 - DNA, 3842 bp, Homo sapiens
  Payload ID: 14360
  Gene Symbol: RXFP1
  Gene Name: relaxin/insulin-like family peptide receptor 1
  Uniprot ID: Q9HBX9
  ENST ID: ENST00000307765
  CDS Start-End: 252-2525
aaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 175000 - DNA, 2130 bp, Homo sapiens
  Payload ID: 14360
  Gene Symbol: RXFP1
  Gene Name: relaxin/insulin-like family peptide receptor 1
  Uniprot ID: Q9HBX9
  ENST ID: ENST00000343542
  CDS Start-End: 1-2130
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 175001 - DNA, 3930 bp, Homo sapiens
  Payload ID: 14360
  Gene Symbol: RXFP1
  Gene Name: relaxin/insulin-like family peptide receptor 1
  ENST ID: ENST00000423548
  CDS Start-End: 264-2618
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgttcttttcatttctttcttttcattaccctcctcttcctggtccctcactgtcatcatgccttaccacttccccttgattcagtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 175002 - DNA, 3861 bp, Homo sapiens
  Payload ID: 14360
  Gene Symbol: RXFP1
  Gene Name: relaxin/insulin-like family peptide receptor 1
  ENST ID: ENST00000448688
  CDS Start-End: 744-2549
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgacactctaaagaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt

SEQ ID NO: 175003 - DNA, 2175 bp, Homo sapiens
  Payload ID: 14360
  Gene Symbol: RXFP1
  Gene Name: relaxin/insulin-like family peptide receptor 1
  Uniprot ID: Q9HBX9
  ENST ID: ENST00000470033
  CDS Start-End: 1-2175
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtgtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatga

SEQ ID NO: 175004 - DNA, 2735 bp, Homo sapiens
  Payload ID: 14360
  Gene Symbol: RXFP1
  Gene Name: relaxin/insulin-like family peptide receptor 1
  ENST ID: ENST00000460056
  CDS Start-End: 548-2578
aaccacaagatcataggccctaaagcagaaacaagcttaaactatggaggaatagaaagaagacaatgtgagtagggtgtgaagcaagggagaaagtcgtagggaatcgagactggacagacagaggcaacaaaaaccattgagaaccttgtacgtgttggacatatctagaaggagtcatctttgaagcagagagaaagccctctccagataccaaatctgctggcaccttgatcctggattcccagcctccagaactatcatctaacctatactgactgataagccttctaaaagcaaaaggaagaaaacagctttgttaatcgaggcctcttctgcaaagttcaccatagtttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctctt

SEQ ID NO: 175005 - DNA, 3676 bp, Homo sapiens
  Payload ID: 14360
  Gene Symbol: RXFP1
  Gene Name: relaxin/insulin-like family peptide receptor 1
  ENST ID: ENST00000342048
  CDS Start-End: 2-475
aatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgacactctaaagaacaatggtgacctgcactcagaacatgaaggcagccttgaaatccttactttatcattcccgcaatctggggtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaaaaa

SEQ ID NO: 175006 - DNA, 1775 bp, Homo sapiens
  Payload ID: 14360
  Gene Symbol: RXFP1
  Gene Name: relaxin/insulin-like family peptide receptor 1
  Uniprot ID: Q9HBX9
  ENST ID: ENST00000471616
  CDS Start-End: 1-570
atgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtccagagcagtaaaggatggctctgaaaaatgaagaggactgggcaaaacaggtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgcttcagaattcagtcattattctatcataggaacttgtgaattactttctccaagattttatatgacaccttgagcttgttgcgttgggagaatttcagtggaagagcagaaccaagtaatgccatcctcatctgagtccctaactgaatgctctacgtgattgcattttgttcatttattcgacacttctatgtgatgggtctagaacaatagacaagatctgtgctgttagagacttgcactttaaaggaaaatgaagaaatgattgcataattaactgtagagagtaactttgagagtggttaccaaagagagtctatgaatagatcctcatctgtaaatgaattattaggagaataaaaattacctcttcct

SEQ ID NO: 175007 - DNA, 3771 bp, Homo sapiens
  Payload ID: 14360
  Gene Symbol: RXFP1
  Gene Name: relaxin/insulin-like family peptide receptor 1
  ENST ID: ENST00000613319
  CDS Start-End: 579-2459
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggtgagtgaagcccctgcagtcacgtggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactatt
